United States Patent 9,567,581 (SELECTIVE REACTIVATION OF GENES ON THE INACTIVE X CHROMOSOME) - sequence listing, part 38

SEQ ID NO: 4461 - DNA, 2092291 bp, human
gggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttgtaagtacaaagtaactaaaaatatattttactgtggcataacgtttagtttgtgacaagctcactaattaggtagattgattttaaattatcacagtagtttgcaaagaagcataaatgttatatatactgcatatatatatgtatttattcaggaatatatatttttcattgggaaaacttttcaacagaaatggagtgtaaaagtttttctttgcgatagaactaaacacatgatttcttgattaacaaaccactgcagtaatagaatatgcagaatgtcatttgactataacagatttattttgattgctgtgagatagtttgtatatctgagttattattttgattagttgatacttccgtatttagtaacagttacataaaggttactgacctgacatatattctcaattgaactaactactgtataggaactacatggaggcctaaaagttagaaaaagtttctctgacacatcatggataaaataaagaataaaatgagttgggacggataattgaaggatgtgaaaagtattgataaagatttaattttaatgtttcttactcacatttactatttcaaatgctcttttctgtagcatatcatgataattatttcaaataatgatgtgatctatgctatcaaatgatcagatgatttcttgggtaaacgacatacaaacttgaggaactcctaattatatttagtagtaaagtcaccttgttgtttcatgtctattatgagccagcttttcagttcaattttttagtttgtctttcatatagaaatacaactatttcgtttatttttaagaaagtcatgatgactaatgaaggatttaaaaatggactgtggcacaacagtaaaaataatatatgataaggactgtgtgtcccgaagagatgggagtttatctcttccccacccatctttgacttgtggagtgtagttattctaaaatagatatgagggcaatgcctataattaagaatgaaaaaataaatctctccaaataagtaatgctccacaactactaaaaaaaaaggcagaagttttgccactgggaaaactttgtggaaataagttaacattgtccatgtattgagtcacattaaaagctaccagactttataatacaatatttacttacattgttggcttgcttcataaatttcttttggtggacatcattattacttttagattgaaaaactattatatttactatcattacaaatatatgcatggcatatatctgttgtttgcaatatacacacacatttttattttttgtttttatttctttgatatatgtaacataaataccatcaaaatcactagtgattttatatatatatatattctacataattaacatcatatacaagtatatagagcaattttgaaagaatatatgcaattctgctgaaattaagcaaggtaaatctacactctgctttgtcatagatattcaaataactttcaattcttagaatgcgaagaaaggtaatctttttgggacatgccctgtaggattttttcacgctgcatttaaaaaatcatcaagtaatgcctatgcaacatgacaatgagtttggtaagaaaaaacggagatatactcagggctatattatacattaaattttgctgtttgacaacatactgctacttggatgtttgacatttgaatccagtttgtaaatttgccgtagtttgataaacttacaaaagtacgttttgttgttttttaaccaaaacagttaccctttaaaagagatcactgtattgtcaaacatattgtattgttcacttttagaattactcaaataatgcattgtaaagaattattcaaatagtgtactgcaaatagacatttcatttgaatatatttaaatgatgtaagtcatctgaggtctaataaaatcaccttttagaatttcatctgcagaatcttttaaagacatcttaactacgaaaaagagattgctgatctaaattgatgatatactgttaatacaaagcttttggtgtatcttacatgacataacattatgaaaaatacaatagagtatgtcatatagatgttactctaaactttaaaaaaagactacaaagtgttctatgcataattacattatttaaggggaaaaaggtgttggctgacactattccagctagacagtactgaattgcaaattcatcatttgggcacagatattaatacagcttcctctttattcctatagcattcatttgaaatccctgtactccatgtcatttgctacatatgaaacaaattgtcaagtttttaaccacttgtgtagtttaataaaagagattaaaatcattgtcttggaaacatcaggtgtttttcaaaattctattttattatctttcatcaaaattttatctcaagagtaaaacaaagtcatttcccaaactttccttctccttccaccttctattgtaatattttcctaacttattaaaaatgatttatcatactttttcatcaactctttatttcatcacacatacaagaaacacagtattttggtatgagtatatatatttatatatatgcacatttatatgcattcaaatcacagggtataaagtttcctaagagggtctaattagaaattaacctttctttaaagataattttctgttcatttttctaaattttctattttaaacacacatcattttttaaggaattgacaaatgagactaatgtacattccctgtctgacaacacagaacgaaccaggaagaaaggatttatggggcctgaggttatacaattgggggtgctattttaagaaaaataatagaaaattggatacagccttgggaggggcccctcatgtaagtaaggctttaatagtttcttgggaaatcacctctgtatgaagagatgtgttgacatttaatcttttcccagttacattttaaaataaaattgatgctagttatatttctttagagcatttattatttctcaaagacaaccttttatttaatgcagattagagagttaaaagaatttataatggtaggaatttgacatttctgcctttcattctgaaaagatacattgattaaagtgatgtcaaactcagttaatggaggcggtgcagttatttgaaatatacagggtatataatttgaaggcacgccaaatcacaatgacaaggaataatgatgaccttggtttatttttatacagtacattcaggttttgattggattcagagagaggcaatggttttctttctcacaaagtcctgctatagtcctaggaggtttgtgttctgttatcaaggcagttggttcgtattggaatattttctggggaaggtcatgggctgcagtgtgggaaataaacgtttttattaaatgcaaccaggtttcatgaaaatatttccccttgtagagtgtgctcaatgcagtatactgatcttcaaaaaacaaacaaaccaagcaaataaatagtttgtagtcttcaccttttccctacgtaaaacatctattagttagacttccttggggtttcatgctataaaatattgacatatgtttggagttctgaagtttcattttaatacagatatcaaagttaaaatggcaacaccatgggataatttattattttaccaagtttggagggttttttctatttatgtcacttatagaattgtccctaaaatccttgcaaaatttcaagctccctctacttaatactaaaagtgaatgtgtcttccagagattctgataaccccttcgaatgggagagtaactctgctatttgtgaatcactcctatactaaatatagttccaagattaaaagctaaaatgattttgtttattttttcatgaaattttttcatgaaaggcttgatagtataaaaagtctgtttccctcatatattacagcatattatagcattcaatgtgccttcttaaaccagatggctcctctagagattatgaaatactttaacacccagggcatagcctttctgtttccccattcaagattacttccttgaatatggcccaacaaaaagaccaaaaaaatacatttggctccagcgttttaagggcatataaattttcttaagcacaattctgataggcagcagacaaatgagaatgaggaagggaaatggctctgctgtcttatgcttaaaagtgtcctcatatagagagaaacaacacaccctggggcctttcggagggtagagggttggaggaggaagaggatcaggaaaagcaactaatgggtactaggcttgatacctgggtgatgaaataatctgtacagcaaacccctatggcacaagtttacctatgtaacaaacctgcacttgtagccctgaacttaaaagttaaaaaaaaataaaataaaaagagtcctcatctcacggccatacaacctctacctcattcccattaaaaacacaaagatcagtactccctcttttatagctcacatcttctgtttaggctgccattttaagggataatttctattcaactctgagctcgatctttattttaatctgatatcactcgttcaaaatacttgggaatttcagtaggcaacggaacacacagagcaattttctggaggcctacaacctctgaaggtgactttgcgtagtatatgtaatgatagtaagccctgagaaaaccaatgttcttagtagtctggatttggtttagaaatcaatgtattcctgctttcttttgtgatcttttgccttctccctcaatgcctcactttcactctgtcattatgaaccccattcctcactaatgggaactgggggagaatggacaatgatcctttaattgaaatggagttgtcatttccttgccatgctgataaaatgttgttgctgttgttgtttgttgttgttcttaaatgactctttcagaatttttaactcagtattttgattacataccattttaagaaaataattgtccataaattaaaaatgctagcaaattgatgaattgattttctcatgccaatttggaaatctgaaatatatctaagactggtgaataatatgtaggtctaattgccatttgaataaaagaatctgaggaagagctttgcctttatttttgtttattattcattttagtttagttatttattttagtagaaaaatgtggttgtgtcaacgaagaggaggtacattaaaatgcattattaaagccaatgcttatccatgtaatgaaatgagaatgtagatggcttaatgggttttggagaggattaagataattttaaagaaacttcaaaaaatcagatgctcgaatcatgatgttttttgtttatatttaataaatatgaaaaccatacatgggcatatcaacaatgaggaattcacatatatatcacgaagtctcttgctaatttgtcaacttttaaatgtgttgtcttcactatcatgaaaattttgatttttaaaaaaggtcagtgttagctgagcacaattaccattacggtgtcccatattatttccaattatgggcaaataaaatgcttaccctttaaatgtttttaccctcttcttggcttttgttttgttttgttttaaagcgttctcccttcttccactctgcttttggctaagactgtcatggaatcaggactataaaagggcataaacatcagtagcttttttctcattcctggcactcatctttatttgcactcaacttgtctcttcctttatcagattacggttgcaatagtaccttagcctgagctaagtgctgacttaaagggcaagggagtcagtacactgttacaagtgcagattttagccttggaagctgtgtgaggaaaaattaaagaaataagaaagaaaaatcacaaaatcagaatggcccacgtattttcatcaaaggcaaattgagtaattcctttttatgttggtgcttaagaacgatgtattagaaataaattggtgactaagtgaacaaaatattaataaactagttgagtaagtgaaaaaataataatctgtaaaaatgatgaatcccaatgactcacatgttgcaaaataactaggaagcaaaagggaaattagactttaaagagcgtaatcagatgcaagaaatgttggcttgtaggtggttaactaaaatcgcttacgggaagctcagacagctggggaatcctgatttagtagacgctgaagggcagggcatgagccatgtgaacagctgctgaagagctagaggattcctttggattaggtgtacacaccccgtctctaatgggctgtcagagagcaccaagtgttatcacagaggttcactttgctcaagcctatggcttttgcagtgttttactttaaatgtctgaaaatggattggctctcaaaataaatccaaaaataaaagtatcaaaataagtgactctctaaaacttgtattgtgtggttttgggtgaccacagtttaaagaagggacttacagctgatgatttgttatccatttattgattcatttgtccatgtaacaaatacacatattgagtgcccattttgtgccaggtactgtgctatgctctggcgatagtattctaaacaagtgaactcaaagagagactagcatttcaaggaggatgtgcatattaaatacacacacacgcaaactacttgcattggagataagggctatagaataaagcacacattgtaataagaatgtataatagggagagttagaccagtcttcgaaattggggaaatacttctgagaaaaaaaaaatattcaaagcaaggcaaagaagaatgaggttagagtatagttgtccaaaagaaaagagggagcaaaaatgtccctgtcagagggagcaatgtttctgaatgtggaaaatggtatggagaaagatctaaaacaagtacagctttcctagagtacagtgagggcagaaaagtgtggaacaagcttgcatctgaatggccgactggggtccaatcattcagagccttgaaggttatagaaattatttttctctttatactaagatcaatggacagccttatgggtttcaggtagaaaactgatgtaaacatatttgtattttttaagactatcactctgttttgtgtgaaagagattggcaagtgcctagggtagatgaaggactatcaatctgaagcaattacggtagctcatccaaaagaaggtgatttggactagaatggggacagtggagatgaaagaagtaaatctattcaagatttgtatatgagatagaatcaataggaattggtgttgtattgcatgctgtgtgctccatgaaatgcacacctgggtggataatggtgccatttgcaaggagattggaagggaaattggaacaacaggaaggattaggggtgtggatgctaaggtgtttgttttgttttgtatttttatgtagcgcgtgggtattgtgcctagaaatgaagtcattattagggatttaaatatgcaactcatggagtggatgagaccagctagaaagataatagagtgtgaagaggagatcggaaattcaataaagaagacaaaagcactaaaaaaaaaaaatcagagaagacacatctagaaaaaatgatgaaattctaaggaaaataatatttccataaagaggtctgttcctttcgatctccaatttaatgacttcatgaatgaggatcccacttttagcattaggtgtcttggtttccacagtctctaccatctatttacccctaatttcctcccatattgctatttctgtgaatattaccaaaatgttgccttagtagaaaagcttcaataaatatttaaattgtataacgtattcagctttttcctgtactctgcacttcctaaaaataccttcttcggaaaccccatttcaactgactactgtataatgaaatgagccttcagtgtaaaacatttatcatagtctcaatttcaattgctcagtcagaattgttgagtaatatgaaaaatcatcctttagagaatacagaattgcatagttatgacaaggtaagtttgcactttatttaatgctagtttagttaatatagatgcttattggagaaatgtctaaaaattctggaggaccgttagtgaaagtgattatcccaatatctgcaaaaatggtaaaaatacctagaaaacattgacatttcagtttaaataaagccagaatcacaataaagagatagaaggcatttgagtaattcaatctaatcatggatgaatgtaatgtacttatcagttagctttggaggaagtaagactcgatagaatagtaatatgatattgagcaactttttttaacattaggtttttaattgcttataactcaacattgttgaacacctatgttctctttgctttttatgagacagcaactctaagtcagagaacagatacacacacatatgtatatgcgtacaactactataaaatatcaagaaagttataaagcatggtacaaatcaatcataaatgattacttatgaatagtgtgattatggacattctcattgaagaatccatttttataaataggcataagagtatggacatacagagatgtgaattagagaatgattgcaagaagcagtgaggcaaaaaggattaatgaaacattgatctgtcttacatacacagctattgacagtaccttgtgtgtgcatagcactattctagattcacctaatcttcaatgataatactgtatttaccatttaacaagcctgtaataagtgtcaggcacttctctgattacatcacatacatatgtgataagttccatattaactctagaaggtggggaaacataatcatctaaatttaccagatgaatatgtagaggtacagggagattaagtaatttgcttaaggtagctcagctggtacgtggtagagtcaggattttaatggtggcagcatgacagtaggattaaagattcttaaccagtcagttgtcacgatctctcagattttaatagaattctaaaaaggatagaacaaaatataaaatggcaggaatcatagtatcttctaacaagaactagacatgtcccattgaggatgctctttaaaaataaaacccattaaaattttgggttgtttactcaaagcctatagacattggcatattatattttcttagataaaaactgagatatcctaaataactcatgcccattctctagacttgcatagggagctgtctatgataatatccataacagttatcttgtttcacaattttattactatctcactcttcttactttgtgaagatgaaaaagatcaaaaataaaactaatgcagccctggtttgtttgtaatcatctacagttagccatccttagagtggtctcactagttgttcttttagagtttatttcagttatgtacaggcaactgtgctacatgaacaaaaagctaagaactgggctaacctgaacatgatttagtattgtaaaaaaatggtttacatagattaacgtgccatactattctgaatagtacttggcataaacagtaggttatttaagttactataattactgttgcctttttacataaactaatttttctcttatcttcattatgttagtcatccacagtgtgatatttagttgcatacattcatatagtgtacactgtacaattctagagtgtaccagtaacgtggactattaatattatgctatgaggtaaatgacacccctggagttaagcaatgtgcactctgtacgataacgtcaacattggcattctcatatatatgattagaaataatactgagtttctctgacttcacaagcaattttattctctcatctcataaagaggtaatgaatgcacacatatctacatatttaaaaataatgtcagagatcgtgatggaacagaattattcaagatgtataaatgagggtgggaggcaaagggaagtcagaaatactccccaataatttatttcaaattaaaagcctattggttattggctggtcgcggtggctcatgcctgtaatcccaacactttgggaggccaaggcgggcagatcacctgaggtcaggaattccagaccagcctggccaacatggtgaaaccacatctctactaaaatacaaaaattagccagacgtggtggcgtgcacctgtaatcccagctactcaggaggctgtggcaggagaatcacttgagcccgggaggtggaagttgcagtgagcggagatctcgccactgtactccagcctgggtgaaagagtgagactctgtctcaaaaaaaaaaaaaaaaaaaaaaaagtctattgattatcatgtgcgtttccatggtatcaattgtttagtattgtccagtaactaactagtatataaaactatcaggataatataaattttaacatttatttaaaatgcatcttcttaactgtaaggttattgatctttggataagctatagaaataagccttaattcagaaatatatttcggagacccagtaggttaatttgtagcactactctttaatattaaatatacaaatatacattgtttttataacttactgctataatgacactaagatgtgtgattatataaaaataagaaattgttagaatttattttattttaatcaatgctgatccatttttctagtgtatgagattagatgaggttgtatgagataccacttttctaggaaaaaagaaagtctttatgacagtgtgatgaatgaagtaaattagctcatttctttcaatattactagtgtgcatagatcttctctttttgtctttctgtctatcatacatacacagaggcacacatacatacacattacttggaaattaagtggtttacgtatgaaagtttttggctttactgataagatcagtaacatgataaataatacaacactgaatacatttttccatttgaaaagtgtaaagaacactacaacacggttgggaaaaaaaaacaacttattatattcaaatgtcattcccaattgtaacaaacatataattatttatttcttaattaagaagctattaataatagtactttaatattcaacattagcagtaactttgttggtttcttttttgataatttgtttaagaaaattagattataaattctgttatggtaaaaatacaaaaataaagcaaagtattatcttctttctatctcttatatgcatcagttggacaagatattgagattctcttttcttttaattgcatgctttcattatttttctattcaagcttcaccctgctaagttcaagtgaagtagaggacttcatgtctctagaaccaattaatgaaatttcttcgtctttcttgaacttgcagaaggtcaatagtgaccattttctcccttcttaaaaatgttgtcgtctttaagatctgtgcactgtcctctcatggcttcactactactttggagggtgtttgtattcagtctgcattgcaggctgatcctctcttctcagcctttaaaaattaggtttccttgggatctagtcctagcataattctcttctcataatgatctcttcctcgatcattgcacttatgtccacagctttattaacacttatatacagataactaaccaagttatacctctagcttagatttctccaatgaattccagaactgtgatttcaactgcctgggtggcatctccattcttatgtgatagtcacctccctctaaatgccctaaacagaactttctcttcaccgcacaaaacctgcttccttctcattgtttttcttatcattgaatggtgcaaccattcacccagtttcacaagccagaaacatatctcatccttgaaactctgatcttttttacccagttatttctaagtcattgccagtcactgtgggttttatcctctaatatattttcatccacttctctttatctcctctaccatcatcctagcgcaatatattttctctcactaggaatacagcagcctttcctttccagtttctctgcattctctttcgtattcttgataatccactctctaaacttcatgcagccaattaaattcgaagataccaccacttgttaaatcatgttagtagtttctcttggttgctaggaaagccaaacaaaacaaaacaaaacacatttaaaaatcaaagtctagacactgcctacctctcctatctcatttcccatcatgtttcctttgcctcgcccccttactggctttctttttgttccctgactaggtatagctttttttttttatctacagtacttttgtgtatgcttttctatttgtctagaacctccccgtttccccttttttaccttgatgacaccattttccacctacaagcttacctctggatagacatcaaaatcccctaagtacatcaaattcctctaccacgtaacatctgttcataacacatagcactgttatgattccatatgtatgtacgtgactaattaatacttgccagtcggattatgtggtaagttctatgaaccaagacacctcaactgttcttgctcaccactttattacctggaaccaaacacattaggtttccccatatatatttttaaataagttacttgatgtgtaatgctttaatgaacataattacagatgtttacatataatatgttataataatgatattttgattgcattttatgaaaattttatatgacaaagcactttcattttggttaaagcttcatatataaatatataataaagatttgctttttgtcattgggtgctgttcccttttttgatttcccatactgcttttcacttgtggttcttgattttgttttttactgtttttaacccatgtcctttttctttccttaatctatctttgtaaagtctcaaagaactagtatctagaatatataaatatcactcaaaactgagcactaaaaccacaaataatctagtggaaaaaaatgtgggaaaagccttaatagacatttcactgaagaggatatacagatggtaaagaaatgcataaaaagatgttcagcttcactagccattaaagaaatgcaaattaacactacaatgagttatcactatacacctatcagaatggctaaaattaaaaaaagaaaaacagtgacaacactgaaagctaacagggatgcaaaggaactgggtctttctaatattgctgatgggaatgtaaaatggtacaaccattctagaaaacagtttaggagtttcttctaaaattaaacatgcagtcaccatacagcccagcaattgtactcttgatatttatcccagaaaattgatgtttatgttcacccaaaaaccttgacatgaatgcagtagctagaaacaagaaacagctcaagtatccatcaatgagtgactgttaaacaaactgttatatactcataccactaaatactacacaacaatttaaaggaatgaactactgatactcaatattcacaactccaatggatgtcaagagcaccatattgagcaaaaaaaagtcaaaggttaaatactgtgttatttcttgtatataacattactgaaatataattatagatattaagaacagatattgatattaagaacagatattggttgccagaggtcaggaataaggcagagggtatgctatataatggtgccacaatggagccttgtggtgatggacctgctcaatattttgattgtggtgtttgttacacaaagctacacttgataatgtcgaatagagcttcacacacaaacacacacacacacacaccagagtcacacaagtgcatacttgtctatctggtaaagcccgaataagctctatgaattatagcaataatttcccagtttttatattgtactatagttatacatggtatcaacattgggagaggtaaagtgaagtttgcacaagacattgttgcatatttctttgcgacttcctgtgagtctataatgattgcaaaataaaaatttgaaaaatacagcattagacctttaataagctcttggttttctgaaggctagggtatcatcaccaaacctaatcgaggataagtcttgtaaattaataagtctatcactcaaggtacaaaggatggtttaatgctaatctgctagaatgcaatccatttctattatatgggaacgtgcatcactgattgaataaaatatcatgatgatggaggccgtattctatatgtcctactttgtaaggtgttgtgtttcaggttgtttatgaccaaaaaccctatatgacaagcgctagaagttatgctggtccacgggcatggtaacttgacaatgcctgagactacctgggttttaaacttgcctctacctacaaaggcaagtaatcctggacaagccaatatttatttaactagtattaattgagagcctaccatatttctggcactgagctgagcatgtctactactgtcctcaagaggaaattaggaaaaataatgccccttcacaagcttacttattgttggctttaaaagggggatatataaagtttcttggtgagggtcaaagtgttgagaataatttttctttgtattattttaactattattgttaatcacaaataactaatgtatataactctaaaagataaatgtacatttggataccaacttgtataaacagatacatagatcaaaagactacctctgattttatgtttgtgcgtgtgtgaatgatctccttgctttcaatctggtcttcagaaaatcccaccttgtaattgctgcccccgttgagtttctaaaacaaataagattgtgtgcctccagcttaacgtcctttagagaatcttctagcttcagggtaaaatccaaggtcctaacgtacaaggtctttcacagtatggcatctgctcatgtctctcacctcctgatctgctgttccccaccaggaacacttctgtctagatataaaattactttggttcagcaaataaaataactttggttcatgtaattttgtgtctatgacttgttcccacttcttggaatgttctcccaaaaaccactatcaccatgtctcttccaccaatgactattaatattatttttatctttccttatagaatattgtttaaaagaattccttactaccctaggtcagaaaatggggccccaatatgtattcttattgtaaactcactatggataattctagacaagcaattatatcccctattttagctgtcagtttgcttctcggcttctgactcactctcttgctccttgaggagatagcctgtgcttattatatgtggattaattgtgcctaacagcttgtaggtacacaaatgaatgactacacagcatttatctgactattgtttagccattacatcactgtatacatatttgaaactcaggcatcattcagattggaaaagccttatgaatactggcatgcattattttgtacacacacacacacacacacacacacacacacacaaaatagaacaggatgggataatcctaagtagatacttttttgtccagtgtactcaatatattgtaaaaattataaatcttagactaaaatgttggttgcttaatttggatgattcatataatctgtcgtgtttttggttatctgtgtactttgttttctctttctttcttagtctcaaaggaaatgtccaagttaaaaaagagccccaatttgtggggattcctttgaggagttacaaagctgagatatcttaggagatgccaaattgatgcaaagtggtggagaggtgagcagagtagaaatttggagaatcacttctgctcctatagtgcatgcatgccagggctgctgtcctttgaggtgggcacaggagctctaagtccagtgggtgtctgaggacagattactgagaaagtgaatggttggcttggactacctcaaagacaagtgtttgctcctgcttgagctattgttggaggtttcctgaaggagacttagaacggaatgtccattccagagagtattcagtttcagtttgctgcattcctaagcttattttccaccctgggagctggccacaatgattggaaatctttcatctgttttaatctgggattgagctcatttataaaaggaaacttagtgtctggataaatatgtgtgcacaagcatggagccccatacaagtatgcccaaattcaaggtgagaaatgtttattgcatgactcaaatacatggaattgaatggactctgaaaacaaaaataggatctacagagccagtctaacaacctattcatatttattatttttgcacttaaatgtttgtaatattttattgaccagtgaatatgaactatattttgtatattacgttaacatattattcatgtaataatgaatttttaaaaactggtgtcttgaaccctttcaatttccaaagtattacagaaatccacagatctggtatgcacaggcattttatgagaaaacttagcttgagtgatatcattaatttactgaagtagtaggccctctgacctgcttttataataaaattaagtttctgtaaactaataagaccatagtaactttttctttaatattttatctttgaggagatttgttaaagaggcttgtatgtgacatgacaatctattttgacttataaaatttcaaccaaagaaaagatgcgatatagtatctttgttcttatctatgacaatttttatgatgatagttccataattaaattttttcttaatgaaagtgtatattattgtattatcttcaactaaattagatcatataacccaattttgatctccgtatgccaaaagcagagaattgaccagccagaaaaccatccaggccttatataatatattgtgcctagatgaaagcttataagcattcttctgcctggggctcacattgtagaaatgtggtgtgcaattttgaaagttgaaaatatagactctgattgagaaatggaaaagagtagagttctaattcatgacatctagaaatcaagttctaccactgaaaaattaatttgcatatattcattatcttttatagtgaatgataatgataataaagacaataaagataatatacatataattggttttataaaaactatggcaaaaaatatattaccattctcacttgtcagatgaggtaactgagtctatattatttgaaatataactttaaaaattatattatctccgctactagattatatactcctggatgccgcaaaccacatcttctatgtgtttatattctcatagagttttgaatatttccttgtactaggaagaagttttataaatgtgttttgaattaattaatatccaaaagtgatggaaagaattataagttacttataaatttcttttgtttcaaaccattagatgatgacacttaattttttgggtataatatgatatggaaagactctcagataacttcaaaaactagaattatgcatacatacactcagatttctaaaaataacatgctatcaattcatcctgcctgccaggtatacaattcatttgagttttgcatgcgcgtttcaattgttcacattaaactgtattcatagatacaaattcacttttggaatcttgggtacttaaacaaaaacatagcctttctaatagaagtataaaaaggatactaattgatgaatataccaagtatctttccaattgcaggaaaccattaaaattgtgtctatacactgtatctcttttatcaaagactgtaacaaaatcaattgctatacatattgaaatatttatgtatctggtatgattacattagcttcagagtggttccaaatttaaattcccattggagaaaaatggagtgagaaatttgtacataagagagaagaaatgttttcttttttttgagacagagtctcgctctgttgcccaggctggaatgcagttgtgtgatctcggctcactgcaaccttcacctcctgagttcaagcgattctcctgtctcagcctcctgagtaactgggattacaggcgggtcccaccatgcccgcctaatttttatatttttagtagagacggggttttgccatgttggccaggctggtcttgaacttctgacctcaggtgatctgcccacctcagcctcccaaagtgctgggtttataggtgtgagccaccacacccagccgagagaagaaattttacagttagaatttatttggacacattttagaaatttttttcctgtaaaactcaagtttcatagtgtgtacgtgaatgcatctgtgtgagtgaacacctgtgtatttgtgtgctataaaaagatgaacacaggaatctaatagcataagtcgcaaggtaagagtattgtccaactaaaatagctaacttcagaggtatgaattactttttgttggtgggtatgattttaacattcccttgaatttattattgtaatatttgccactaaaagaaaaaaatcatggcttagaaataaatttaaagtaaccaagatcattgctatataaaccagaatttaaattgagggtttttgaaccattagggtatatttcccctctggcttaaatttgaaaactgatgaaattttagatctcagcacatttaatatgtctaaacaatactcatttgactgcaaaacctgtatatgtaatttccaaggcccagaagttcagtatttgaaattaaattgttgcatattactgagaaatattatcttaaagcatctgctccttctgctgttctaagttaggtgtgtatttctcgttagtgctcagtcgatgagtacaaataggcatgcagcatgagagcagagcattcatttcattgactgcaattactaacatgatttttgacatcttattcattgggagagtgtcttttaatgttaatttgaatgaatgggaatactttcacattcttaatgaatctgctcatagagtaaaataaaacatgactgttatgctttgaagatcaagaatcttcttttacacaaaagggtaaaaaaggccaaagaaggtgaagtgacactcttcatgctagttccaacacgagtattttgatgaacaagaaaaaaagccttctttagatgtaggtgaactgggtgatttggcattccttcctctgaattcccagggtattttgcctgtttttctttaactgcatgcaattcttgtcctttatccactgtttacaggtctgtttctcacaataggcggtgagtttatttacacagtgactgctgttacatatcacatgtactaagtctctagtgattgttgcttaacgatgactgaattgataggtcctagcatggctgatctctcacattattcttgtttggtttgggtttgggtatgaatggtggaaagagaaatggctggctctgagcaacatattacaatgggtttctagcatctactcctcacctagtactagcttagacagtgagcaaaataaaaccataaagcaggccaggcatggtggctcatgcaagtaatcccaacactttgggaggccaaggcgggaagatcacttgaggccaggagttcgagaccagcctggccaacatggtgtaaccccgtctctactaaaaagacaaacattagctggacgtggtggtgcacacgtgtaatcccagctgcttgggaggctgaggcagaagaatccgttgaacccaggaggcagaggttgcagtgagccaagttcgtgccactgcactccagcctaggtgacagagcgagactctatctcaaaaaaaacgaaaaaaaagtaaaagtaaaaaagctaagaaagcaaactatgtgttgtcaagaagtgtttatttttgcatcttgaatttttaaaggaggaggttcagatctatttgttagatgacacagggtttgtgaaaactcttgcagaccaatgaaatcagaacatacaggcacaccaagtgcagattgtgtttagagccactgttctaaaagcaggtgtaagagggttgcagttatatcccagataagagccttagggcattaggaatgaaaaagacaaaatgcaaacaaaagatatttagatatttaattagtaaaacttatttgcgcgggtaatgaggagagagacaaaaatagtagagagcaaatcatcaatactgacttcctgatttcttactagggcagtataggtgtacactatatatatatatataatattatatattatatatatatatataatattatatattatatatatatataatattatatattatatatatatataatattatatatataatattatatattatataatatataatattatatattatatatatatatataatattatatattatatattagtactacttccttttataaattggacagaaagcttatatgtatagaaagaaagatcaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaagaaagatcaatattttttcaaatgtccagccaattgtttaagtaagttaaggtatgtaatctaaacttataatttaagtttaaagaaaaacattagaccaaatatttagccattttgatgtagccaagtttatgcttcaggagagttgcatagttatgaattgagctcacagaaatacaaatacacacgtcatcatagtgtgatatccagcatagatggggggcagttatcataaatcctgtcctaggctgggtttggaatgtgagacagattttataataataatatttcatctacataaaacagtccatttcctggactataaggatcatgataccatttgtttatcatggctacaaacagaacaggaagtagtatccttcaacagagaagataaattataacagtcattatttagaatatttgcaattcctttgtgtagggctattctttgttagctgaaataaagctctctgccttgattacagttatcattttgtgaaaatattgaatgagtttagattcctaaaggaaattagaagttgagtaaaatgtacattcacttagaaatttccttgcagtgaaagatgctgattactataaatgaagacagggaaatttcattcatttaaagagattactacaggtgacaagtttaaaattagccttaacttaaaagttggaaaatattttttcctgctagagactaatgccaactccgtgatgtatgtaaggtcatgttatcaggacccagcttattgctgctacctcctctcctacccttctcctcatctcttactcctaaccctttagccaaaggctcctatgtgcgggcccccaaactaccatgctttcgtgttgtcagggataagtcttcctgaaattaccctccttctccttaccaatcacttaattaattaaagcctggtttccacttcatctcaggaaaaattatttcctaacccctctcaccaatctccattgactccgccaatggaggttaggtatggttttaaagtgttctcatagcataagttcatcaaaatgcacaatatctttcaccatattttgtcaatttatttactttaatatgagaatacaaatatcttggcatgtttatcagtgttacacggatactgttattttatcatcatgtttcccacctctcccccatacctagagatgagcataaggcttaatatataaagttatttggttaatgctttttttgaataaacaaatacatatctaagggcatgtgagcaacagagttcattgtaacactatgcttacagttaatcatctttttgttattgttctagcagcaagaaggatatatatctatatatatatacaaaggggagaatgagaatgatctgaattcaaatataaaacattacaaatgaataaggaatgtattattttgctagcattgccataacaaaataccacagtagactgggtttcttaaacagaaatttattttctccacagtagtaaaggctaggtataatcagggctgatttcttctgaagcctccctccttagtttgcagaggctgccctctccatctgtcttctcatggtctttcctctgttcctgtctgtgttctaatctcatctttttataaggatactaatcagattggattagagctcaccttagtgacctcatttaaccttaaatacctctttaaagaccctatctccaactacagtcacattctgagacaatgggggttaggacttcaacagacgaatttgggaaaggggcaatttagcccataacaaggagccctgtcaaataaaacagctttgagagcaaacaaaaattggcatctgagtgaaatatgtgggaagaggaaaataacttggggctttgctgttctcttcccactcttcctgtgacccgactggttccctgggaaatggtctttggatccccactgctgcttaagagtctgttttttttcccctgagttactgaggactgctgtcagtatgattgtagtgcaaattgatcctttgtgggaagtacaatagcaactggtaaccacaaagtaccagagggcaaaagaactgtagacgggtaaataaaaggtgtccgaaaagagcaaagggctggaagaatgggaaaatggagaaagtaagatatgcattgagaagactgatgattttttaaaatagtagatgttagatagatgatgagagagacagagagagagagagagagagagatggttaaaggaaaactggtatttggtctgcagttttgctgtttcaccagcttaacaccctacagtgaataacaaggtcatagatcatcacaactgcagaaaacctggagaatattttccatttcctcattatatagatgtggaaagtgagactccagttctcagaaacagttagatacaaaactaagacccagctagttctcagccagtgattttcatatcataccacacgctatacagttgtaggtttagaaaaaatctatggtataagaggaccatgtagtaccttacaatgcttctgtaatacccacagcatcataaagagtaataaatttaattattgcaacttaatgattcaacaattgtatatgtatatacgtaattatacatatatatgtgtatgtataaaatctaccaatacatatgtaatgcacatgtataaaatctaccaattttctatatatgcagaaaacaacaacaacaaacagtattagagaaaaccagggaattaagtcaaaatcatcactcccagacctgaaataaatttcaaaagctcttcgttactggtcctttatttgtccttcctacctcattttttgccccactcatataccacacattgcaactatgctaaactaccttattttttttagaaaaggacatcctcctcatacctacatttgtacatttcctttttatttgcttttttcctctcctgttgccacagtaaattcctaagttttctctttaaggatctgtggcctgctttggatacagttgagtgtagtgatattgtgccttgcacatatctctagaacaaaagttattctgttatagaaattacttatttactatcacttaagatcatttattaccatttactatcatactctaattcacagaaggcaaaaaataaacccttgaatggcaagaaatgtttaggcaatgttgggcaaattgtttatgaatagtgattgcaattaacatagagcttcatacttactggattaaatattgatacttttgagtcatatctctactcttagcaataatattggtgaatattctgtgctgtaagcaatgtaaatcataaaaacattctaatgtgtatatgggtattgaatattcaatgatattaaatcaatgttcaattcatatagatgattcttttggaaattaagaaatggatcccattttaatgagttttccccaacataaactatactttgttaagttcaacttgacaatttacaacgctcacatagctttcagatgtatacttaagatatatggaaatgaaaagcaaaatgttgtgaacaggaggtgacaagatattttaaatttaatcatcatatcttttataattaaccttttaaaacatttaattggcattattgttagaaaactttagctctggaagctaaatctttagaattgttgacttgtagacaagtcaaatatccaaaataaaatttcacccatcattagcagtagatgtatctagggtgaaattacacgctggattacttcaatattcttatatttacatttttatttttttcaaagtttctccagtgagcattttattgtgaaaatattaattatattttaaacttatttttagtttaagatgagaagatagtctttggggtagataaatacttttaaatctttcatttagaagttcctggactaatattatccaggtcccacttccttaaaaaaacctaatgtaacctttcccatataagcattgactgctatttcttgtttcacaacatttatgtggtatgtctatgcctatggtattgaatatatatttgaactctgctggcctattcccatctctcacagatcccaagacaatagagatcatgtcttacccatctttgtatctcttacagaaaatagatctcaaattctacagaagatattgaattgagagtttgagatgttagaataagaaaaggcagtgaaaggagagcctacatgtagcctaggccagatttacaaaagcagtagctcagaatgagatagggattcaacaaggagaaccaaattatttggtagtaagttgttgctaaattgtgggagatgaggaaaagggaataatgatagcagactccctgatattaatcccccaagagtgctctatggcacagtaattattcattatgggccccctctgtttggccccacgcccccaaaaaagacttctttagtcataaaactgaggggaatactacatactaaatccccttagagtttctcaatgtaatgcatatgcaaagatgctctggaatcctgcaggaaagacagctgtttaacttttaacctagtttcccaaactcatttcaccatggaacttctttaacatgcagtcaataaatgcccatttatctaatgtttaatgaagcatatgttggaattcttaaaattgttaatagctaatcaccgtgaggaactggtgagatgatggtaacattaacagaagtagagaaaccaggaataggatcaaaattggaggggaaggggaaaagggccttttgttttgagacatcaacttagaattgttgatgggctatccaggtgggtagataataaaagtttttgtgggggaggactaaaactaaagagttagacttaagagagaaatacttgagaatcacttacatggagatagatgatagttgaagttaaagaagagaacgagatttctaacggagggaatacactatcaaggaaaggattagagaaccctgggggagtgtgaatatttgtgcctcatttaattttcagaaccagatcatgaggaaagaatacttcccattttagagattaaaaaacaaaaccgaagcacagtgcttaagtaactttctcaaggccatataactaataagtggcagatatgagattttgagccctactctaaaacttgctcctcaatttgaatgtttacatatttatgtaaataatatattttacaatattaaaaacgtttttgtagagatacaataaccatataattttacaggattgtcttttttatttacgtttttctttggagtataatacatttttaattattggcctgagaagaagatacaatagattatttttggcaaatggtgcactcattcatgagagacactgtattttctaaagcaggctgatctctgcataatactggctccctgaaaataaatccttgctgggccgggcgcggtggctcacatctgtaatcccagcactttgggaggccgaggtgggagcatcacgaggtcaggagttcgagaccagcctgaccaacatggtgaaaccccatctctagtaaaaatacaaaaattagccgggcgtggtggtgcatgcctgtaatcccagctactcaggaggctgaggcaggagaatcgcttgaacccaggaggtggaggttgcggtgagccaagatcgtgccatggcactccagcctgggcgacagagcgagactctgtctcaaaaaaaaaaaaaaaaaaaaagaaagaaaaaataaatccttgcaatttatctgccatattgaatttgttctggaataatggggataaaatcaaaataggaaataaagtatcaattttattccactattattttatttattattttcatcttagtcatatggaattatatttataggaacatgttaaaatgcattttcaagataattattgcacacaatttaaacaattgttttgagtgactttttgtagaggtagaacagttctgtaaaattaaggtttggctttgctttgtttgacctagattccctattaatttcaaaataaatgtgccttatatttcaaaatcggatttcgtatatgaaagctcatgtcagttcacaacaaaaaaaaatcattaaaaaagaatagtgcgttattttattactgttttgatagcaatacctgaggataccgtaaatgtgtgcatgtacttttgtttacaaataaaaaacagttatgagaagacaaaaaaatctaatgtagaataatttattccactaaaacccagctttcctcatggaaatcatgcaacacctagtgagattatgctagcacatagggaaatttcacaaatgcacattcttagacatattaaccttctggatcagcattcaacaaaggtaaaataatgtacgctattgatatcagactccttagctccctattctggctcccttttaactatcaaaacacagtaatctgtgttttccttctttgtacatcagttattgtacctgccactctttataagcattcacttttctcttgtttttaagcacagtggtagcaatggccatgacttagaggcttaatgaaatgaaggacagattataaacaaattaaacccacactgctttctttatagaagcagctgcagagtgttctgaggtttttttttttccttgttgagtaaaggaactaataaggaaaatttcatggcttcaaggtctagagataagaaatgaaagttgtaacaggagaggagctgggaaaagcacagaaatgtagatttcgcggatcatgatgaaagccacaggtgacttggtgaccacagaaatgagaacacagggttgggtgtctaggcaggaagttgggaggctggtggagtcctggttcaactctaaagtctcagttatctcagcacatgctcttgtggtgctgctgagatttggctgattgcctaccccaaacctaaaaatagccgagcctcattcttttgtagtggcagccagaggcgcagctgtgtggggactggctatctttttccttagctttgacaaatagctgagagttggtgggcttgagtgtgcacctgttgagacagaaagtgctgagtttagttgacaacactgctgaaggtaatttcacactttcattccaattgatcaccgaaacttagaaaaattttctccttttctaaatccttctccttgcccatgaatatatacatacatatatttttctcgaactgtttgagagtgattgttaccaaaggcaattgtttttaaatcagaataacaaatctcctgtttgagtggctaactcaaattttattttcttatttaatttagtagaatttaaaagatttaaaatagttttgaaattaggaaataatatttttattcccataagtctaaaggtacaatctagcccattacatcactataaaaaatcatctccatatttattagattacaggatattccgctttaaactagaatttgcgttgcatacatttttgcagaaaaactcattcttaattttttctaaaacagtagattggatatgtgttaaaggttcatgttctagtacttctttaaatgcttattgtcagctttataaaatcattttatcacaaaaagttagttttctgtaggcttattttccttgataggattccttctcttacaaactggttatatgaattaaaatgtaaatgttagtgaattgtcatatcttgtaaatatactagggtagaactgatatctttatgcaaattagaaaaatattttacagtatcagttatggagttttttttctactcttcctttttctttgttaatattggcatgtgatgaaatcactactttataagtttgctactttgattaagactcagaaatcagagtggctgggtgtggtggctcatgcctataatgccagtactttgggaggccaaggagagagaggatcccttgagcccaggagttcaagaccaccctggacaacagagtgagacctcatctctacaaaaaaaaaatgaaaagaaatgagccaggcatagtgacaacacgcctatagtcccacctactcaggaggctgaggcaggaggatcactggagcctaggaggtcaaggctacagtgagtcatgatctcaccattgcattccaacttgggcaacagagcaagattatgtctcaaaagaaacagatcaatcagagaagtaactttaaatattttaatataaaaaaaggcaacatctcttagcaaataaaaatagcgacgtccttctctttctgtaaatctatccaagacatgagtgctgttatcgattcggtttagggttttgttttgtaatatttttttcccctttcacagcaatacattttggggtatggtttgctgacaatattttccacagtaatcagtggcttagctgtaaatagaggataagtattgcatctggggaatacacattagaaacaattggtatttctggttcatataaaggtggaaaaatacttggccagatgggcacttatttatttattttcctgaccagaaataacaggcaatgtgtgagaaagtgtggaaagcactgggttggccgtcaaaagcaggatcttacaaaggttgaaggaagctaatctgctgagaggttttctttttttaatgactttcacatagtatttttcaaagcctctgtgcattaacactcacgccaaaggaaatgatttgttttttcaagcacttggtcagtgcaatagctccgcagctaataatgacatatggcaaattttgagtacttactttgtgctacgtactgtaataagagctttgtgtatattatgtgagtaaatacttaggacaagcctgtgagagagctattattgttcccattttacagatgaagaattctgagttagaattagactttgaaagtcaaactttctccttccctatcccttgctgttatccaccacatcatgctacctccctgagctcagtgattacctacaatgaggtttaccagcttgtcctatagttacctgtgttataactgccatgttcctgaaataaattaactataaaatggtgcccatcgactgatatagagaccagtcattttttttttatagttttatctggcctggggttatcaagatactaggtttaatagaacttacttccagatttaaatgtctttgttcattcatgaaaatcaattgattggatccaatgattttagatctagacaactgtcagtcatgtaatctaactaactcattgtttaaagaggcaactgaggtgctgaaactttcaataattggattaattttatctttagtcagttatatcattagaacctaggtctctatttcttaatctcaaccaaaatatacatacatacatatatgtgtgtatgtaagcaccatttctgctaatttacaaaaacctagcaaaccagtttaagaaaaaaaaaagtttcctttgctcatgtaacgaaaaagtgaagaggtattacttacttcagatacagttagttttgggatctcaagtgatgtcacctagcccagtacctctctcaccctttctccactgtgttttcaaaggctcttaaaaaaaaaaaaaaaaaaagctcttagacattatctctcgatatgggacccattattagtcttagacttatatcattgtacctcaattccaatagaaaatgaaaacaccattctctccaacagaagacctaggattacttgtaattgactctgaagaaatcacctacacattcctgaatcaatcaacctagttcaggagtacagtgttctgattgggcaggttccatcagacacccactcctggaaccagagccaggtaagttcaacccaaaactgtcagagaggagcaggggtgggtaggccacaacgaacagagatacaacaagacaaacagtgaagaagaagatgaaatgggtagcaggcataataagattataaagtcttgtaggtcccaaactctgtgtgtatgtgtgtgcatgtgtgtgtgcgcgtgtgtgtgagtaaccctcaaaagtatacaagtattgtgcttcctgtaatgacagacacccttctgttgataataatgattcatgtagcccaagaatataagaaagtattctgtttgtaaaataaatatttagaatgggaataaatttgtataaacagaagcatgtttgattttctttaaaaagtgcgtgataaatatgatgatcccaggaggtttgttcgttatttaaatgtttaaacatgtgatatgtctctttcagaataataaatagtagggaatagcaatatagcacttttcggccgggctcagtggctcacgcctgtaatcccagcactttgggaggccaaggtgggcagatcacttcagatcaggagtttgagaccagcctgaccaacatggtgaaaccccatctctactaaaaatacaaaattagccaggcgtggtggtgcacacctgtaatcccagctactcaggaagctgaggcaggagaattgcttgaaccctggagacggaggttgaggtgagatcgtgccattgccctccagcctgggcgacaagagcgaaactccatctcagaggaaaaaaaaaaaaaaagcactttttaaaaatcataatggatttctaagattgtaatagttttggtatgctgattggctttatttttggctacatttattttagaatctctgcattatcaatgaactttcattcaatttcttttctttctttttttttttttgagacggagtctcgctctgtcacccaggctagagtgcagtggcgcgatctcggctcactgcaagctccgcctcccaggttcacgccattctcctgcctcaggctcccgagtagctgggactacaggcgcccgccaccacgcccggctaatttttttgtatttttagtagaaacggggtttcactgcgttagccaggatggtctcgatctcctgacctcgtgatccgcccgcctcggcctcccaaagtgctgagattacagtggtgagccatcgcacccggcccattcaatttctaaattaggcataaaaacaaaattatttcgtaacatttctacaatgacctcctttttctgttaagtttctaattctgaagacccaaattcaattttatatttcagtatctcacactgattattctgatagttacattaaatccctcgtttagaaactgatgcaagttactgttttcaaatgttcatgctttgaaagtacatgtttgtcatctgatttcaaatctgcatggttccatgctgattattttagataacttcaggctgtactccaatttttttctgagagatctctgaagtaagcttttcttactctgttacaattttaatgagatacattctatgtattagagtgtgaaatatctctttaggacaaaatttaatcatagtcagtgctccttatttaaaggctaaaggcatcatcaatttggcaaaaaataaacaacactatctggctgcctgagggtccagtgactgaccttgagttgaaatcccagctgcctgcatcatgtgaccatcaacattctgtttttatcccagtggtaataaataccttatactcaaaaagacaagagcaactcagaagagagatttggtacttttcaaagaaacgcagcagtaaaagttgcatgatgcttttcatttcaaagcaggcaaacagagctttattatggcagagcagtccaatttaattttcacttgtgtgatgaaactattccacacgtttgcattaatttatgagcctttgtctggttttaatgtatttaataatacatttatacactctttgttttaaaaataatgatatgttttgacaatgcactttttcaggaaaatctgaggtgtaacaaaaagtgataatggtaagatagttcccattttgagtattaaaaaatgagtgcatcaggtaggattgggtttggctgcgtgtatcagaaatccagaaatagaagtgtgttaagtaagagagatttgttgccttgccacatgagtgagctccagctggaagcagtacattgccggtagagcagggccatggtggtcaaggacccaggaaccttccatctttctgtgcaactttcggtcttcgatgtaacatcattgtctaaaatggctgctggacctccagcctctttccaggtgtcaggaaggactccagcagagtgaaagggtttgtccaatttaagaagcgccctttacacagctttcctccaaatcccactggatatttctgcttactttcccttgcagtggattatgtcaaaatagtctaattccttcttttataacaattggagttgaaagctttgtttcaatctctagtgacaatactttagattctgattcccattctctgagggcatacatccgtgttactaggttgttactaaatatgcatgaatcttaactcaagttttttaaaattccagtttggaacccttggagaaatcaatacatctgttcgtattttgcccaatagtctctatgagtgctttatctaaaaatcataaattcagatacatttttaatatcatgagactaaagaaaatatttcccgttgtcaacagatatcaagtttcagttataaaaaatgagtaggttctggatatctgttgcacaacagtgtgcctgtagttaacaataccgtattgtatacttaaacatttgttaagagagtagatcttatgttgtcttcttattataataaaataaaataaggtcgggcgcggtggctcacgcctgtaatcccaggactttgggagtctgaggcgggtggatcatttgaggccaggagttcgagaccaacctggccaacatggtgaaaccccgtctctactaaaaatacaaaaaattagtcgggcatggtggtgcgcacctgtaatcccagctactagggaggctgaggcaggacaaccacttgaaccagggaggcggcagttgcagtgagccgagattgcaccactgcactccagcctgagtgacagagtgagaccctgtctcaaaaaaataaataaaacaaaataaaataaaatttccgtttgtatactgtctttaagacccaaatcaattctctctgactctagtgggcactgatatgttctactgaagtccccatcaccaggtagcacacccatcccctagctgctgggagtgcttgttgcccacagctgcttccttctccagagacttgttcttaccctgaagaaagccaggagcctgaaaggccatatgtgccccacctcaggtcagtttgcaaccaacgactgaaagtacaagagtccaacccatttgccacaaggtgagatcagctctgggatgcaatttgccctccagagctccctgtgggatcatgtggaaattggtctctaggtgagatcgcattcttgttttgttttccccaagccctaaactgtccccttcacacagtttctcttttgagcactttctctttttattttattttttgagacacagttttgctcttgtagcccaggccgcagtgcaatggcatgatctcggctcactgcaacctccgcctgctggattcaagcaattgtcctgcctcagcctcccgagtagctgggattacaagtggagcgccaccatgaccggctaatttttgtatttttagtagagatggggtttcaccatgttggcaaggctggtcttgaactcctgacgtcaaatgatccacccgccttggcttcccaaagtgctgggattacaggcgtgagccactgcgcctggcctattctaattttcatcccttcactcacaaatgctatgttccatcaacagcttgagtgtgcacatgagcgcacacacacacacacacacacacacttctgtgcttgctttttcgtggctgcaaacctgctctcttgtgaatccctgaatccacgtatgaagccgaagcttttatttcattttattttttagttgacaatataattatacgtatacctggttttttttttttttacattaactcttctccttatttcagctgagtttctatttatgcacaatatttattgttccgactcaggggaagtttcaagacacaaaccttttgacagcctaaattagttcaggtctaattcagaaacagaagtttccagattagaaaacctgaagctaaagaagtgcttgaagaggaacagggattcatgcaaaactagactaggtaacagagttactcatacacaagaatcttggcaagggttgaagtgggcatgtggaaggggctggcttgaaaatcaggagggtcagagaaagagctgttattgttaccctttgttcctcctcagatgtctatgcgaaaggctctctgagatgagagcacgatatagctcatgccggttcagccacttaatcttttttgatttgactgcacccaggtttctttaaatctgagctttagtttccttaactgtaaaataatggaaaaattcctggcccctcctcacctggttgctatgaagattaaatgagataatatatggaaaagtcttagcatataataaggtctggaacatgatatacatttaataaaataatacattttacttattattatcttatacctttcatatgaatgttaactgcaaaacagcatagccggtatttgctccttcacaatagaaggtaatatgcttccctgttttactaatcagaaaactggcctcgaagaggttaaattcctttcttagaactattaagaggctaagccacacttcaaactcaggtgtgtctgactctgtagtcaatgttcttttcacttcatggtgcttttttcctgtaaagtgagtataatatttcctaaatcataataaagctttgtgcattggatgacataaatataaagggcatagtgtataattggtactcaataaattattccttttcctccttccctaggcaagaactaattttctttctttgtttagcccctgtattaccagccaagtgccttgggcataatatacgtaaataggcctagtatgttgaattttaggcagccatcttgatttttgtaacaaatctagttctctttaaactattgcttagctcttccaacaataacaggccttgtagttatcccacatggggtgatttcaaagccacagagggaagattgttcttaagttactcctgcatgcagtgtcaagctctcacaactttcacaagaagttaaaaactacaattttatgtcagtctctcctccagtaatcagatagcttctttgattgttctgataacccaagagggaatccttctgatacagaaggtggctatatctcatatattttgcaactcctcccaaaacatagatcgatcatctcaaagaactacatgggaaacttgatagccttttggaggctgagaaagaaagctaagccaaccttgaaggaagtcaacaaattgtcaatggcattttgaaaaactgcattgcaatagacatctacactcatacgttatttagctcccttagggatatgattactcttggggtccacaagattcgatgcatgatcatttgagaatatttgtggctactattattttttaaacagatcaacaggcatgacagaatttcatgcatgaatttcatgataaggcattctcaattttatgttttcacttaagtgattatctctaatgttcatctatttccttcttatttcaatcctaccctagtttcaacccatccttttttatttttttcttgtttgaagtttaccctaatttcatgactgagcttctctaaattccttaattaagtcctccttgtccatcccagtacaaggtgtaatcactttcccctatatctggattgttcatctggttgttatgtattgcattaagttaatatatgcaaatataagccttgtaaatacagagaccaatgcagtccaattttgggtagatgccacattcaaaacaacaataacaaaaattaattaagtagtcacacacttaaataactcaaaagtgttaaaacagatatgaagaaatccacagcaacatttattataaaattactctttctcttccttggttttgcggcttctcgagttcataggagactttcagtttccagtgacctggaaactcaccattcctcatcaccatcctttactgtagtaacttccttttacctgaccaccctgcatagtcacagaagatgcactcctgacaagtgatcctcaaaacaggtagtaatctctttgagaagtgtgaaatgtcttttgttctccttgtcgttcccatgattgtcagctgtgaggacccttgtcattctaccctcaatcccaattctgcagggtctggggattctggggattcttttttttttttttttttttgtagttaccaatcttatatagatacaataatttttatgtgtattgatgtttattgacaaccagattttaaggtccttagaaattggagttaattattatttatcatccaagctcctttccctctgccctcttattttccaacacagtgtcttgaattttatcactttatcgtttagttattaagggtgatttggtgaaatgtagaacagactatatgaattacctcagcttatggtattatatgacataataacagaaacataaatagactatcataaatcttaactttttctttattctttgtaatattttattagtcttatccatcttgcttggattgccaagttcttctgagaattccagtaataatgttatcattctatcgagcttattattcccaactgatcttctattaagccagtatgaattagctactgtttatgagattagattatgcactttaatctctagaagaagcaaaagtaatgaatacactgaatctgccactgagaagacactttaaactgaaatgtttcattatttttctaattcctctctcttttgaatctgagtatgtttttggggtacgatacagtgtaaaggtttttgtacatcaagtcatagacttggaaataaaacacaaacaactacccttttgatgaaaatacataaacatcatagccatttagccaacttttaaatttaaaacaataaattcatgattttagttggagggtaaacatgcatctttttaaaaatcaaatgtaaacacagaatctatactcatgatgtacacacatggacataaaatattgcatatattttgggagattcaaagaccactggactccaagttaaggatatttttctctaaataaacttagtgattgaattatagaaaaccacaaactaagttattgactgaagtataggaaaagtatagtgtattaaaataaagttttggactaattaacatgattttactaatagtgacaagaggatttaccaagttctgattttttctaatgtaaaaaaaatttgttaagtaagatctttcaattagtaatttctgaaaccccctctaagtaaattaaatttttatatccttgaagaaggatgttgatcagtctcaccttatggcaagtatctcaatatatgtgatctgtcacctagtcttttctctattttattatttctgtgtttgttgagaaaaaaattatttgtatacaagtgcatgtactatttaatgtcatgtaattaaatccctttgatagaaacagttaatgttagactaataatgtttttagctactggtgaaatacttcctcctaatgcgttaaatgcaggataagatcttacttgatactaccacgggagtgtaatctctcccaatagtgtttgtttcatcgaagttggctcatttaggtagtttgagtggccagagttgtataagtatgtttggcagtggtggatggggaatggacagcaccaaaccattctttctctctgtttcgatttttctcctttgtctattgctagttgcttattcctgagatatccttcacctctctcaagaggcttggtcacttaacttcattccaactctacacctccattggtggaaatggaaagatggatgaaattttagcccctgtttatggccagcatccgactagtccttctttcaaaaatgagtaaataaaaacttattatggtatctttgaaaagttgcctgtctatgctctaggctttaactcaataaattattttaatggaaactgtgaattcaaaggaaataaaagtatggcggggaattatgcagaaaatactgtaatatatgttgataaaattttcccaagttaccacacctccagtacctagaacatagccagccatataatagacactcaataaaggtttgttgaatacatttgtttaatattcctttttactcttttcctcccctcttctttcccatgcatttctagttactcacatttataataatatattcagtacattttttgtttgcgtcaagatgcatcatgagggaatcacctgaaatttcaagtcaggatgacctggttagaacatcagttccaaaactgaatatttagagatccttttcctatctataaaattggatcacaaaatatctctcaaagggtacaaagcacagcaccaaccatatattaataataaggcactgttacataaatgtcagttcattttctcatcaccttcttaaccattttgctctctcttctgtttcaagacagtaaaatccaaatctctgtcagtaaaagtatatctgaccactctaatttaataaaatgcagcaataaattgcatgactcatttctcaattattttgcatgacttactaaaagtataagacagggtacctgagggatctgtgagggaaaggaagcaaaaatcatatacatagaagtggttggtttcaagtgattaagaataacctacgagtaggtgaaaaaaagaatcaggacaatacaatagactgcaaccaaaggtggaaaaaactgtaaaagaaatagctttagaggtctcaaatctgctttcagaatgctaggatctagttttcgtaaattagagttctcagtaaatgtaggacaagtcccagctgtactactgtagcattaacattaaaactaagccatatcttgaatctccttttctcttaaacccccagaggtttcaaaccagagaggtggtcaaaatagattcccctactacttcccctttctcaataagaagctctcatctgttgaatttccattttgaggcatttagacagctgagagagagagagagagtttaaaggagtgttcaatccatctggtctgttttttccccaaattgcggaagttatcatttcagtaacattatatgttgttaagcttatacaataagatctgattttaaaacttaccacataaccacagcaacaaatattgtgttatattgtcagaaggattgacacatagatcaattgaacagaataaagagtctagaaacatacccacacaaatatgcccaacatatttttgacaaagtttcaaaataaattcagtggaggaagagtagtgttttcaacaaatggtgctggatcaatgggacatccacggacaaacaaaatgtacatagacctagacctcatacctactacagaaattcacagattagagtgagattatttttctctttcttacagaaatcacatccatattgtctacttctgtgaagttcagtatggtagccacttgccatctatggccattggaatgtagctagcatgaattgagaggtactataaatgtaaaatacacactggactttgaagacttagtgtaaaaataatatgaaagatctcaataataattttatatgcgttgcatcttgaaatgatagtatttgggatctgtttggttaagtaaaatacagtatggatgttagttttacccatttctcattatttgtaatgtgggtatcagacaaattaaaattacctatgtggcttggatcatagttctattgctcatagctagcataatctataatttccagtttcagtttctttatatctgaatgagaaataaaagatatttgtgaagcaatctgcacatagaactaaagatttttattatttttaataaaattttacatttgtctgtccaagcatttgaatcattttgcaaccatatttattgattatttctacaacattcagtttagattttgcataaataaaaacttttgtaagtgtatgacttaataaatattaagcaggatctagtctagttacttgggaacggcaaagccctcgtcttcatggagcttacatttttcagttgataatctttatgtaactctagaaataattataactggcttaactaagttagcttttgggtacatactcaacttgtgagagcggaacctcatgggtctaccaatgagttgagtattacctaaaagtatccatcttgccctgggcattagccaatgtacttttcagaggaaatgcagggtgtttgttaatctggcaaattacctgagtaggcattggttacatggaagtctattcagagattttcctctgtactacgttgtattgactgattgcttttctgactttctccctagattctgaattcatcaagagttctaggaggggggctagcgattaaaaaaaaggacacattaggtacaatataccctactcaggtgacaggtgcactaaaatctcagaattcaccactatagaactcatttgtgtaacaaaaaaccacttccacccctaaagctattaaaattaaaaaggaaatacaaataaaaataattttaaaagtttttgctgcgtgttagcacctatgtcagtaattggtaaataataagtgtaaataaaccaactgatggatgaaatattttgagagaacattaattcaaaatttaaaccagtcaatgtcacattcaagccagattgcccaacctagtatatcatgaccattgacttcaatctttaatatggattgtctaagtcattggctggaagggagcatctgtctttgttttgtcctttgaagcaaacacttgaaatcagtttagactctcatctagacatttttgttgtttagaaatatatttaatggaatctttaggctagattcagaagagaagtaagctgtcattacccaaggattgttaaccttatcaataaattcgtagccctagggcataaagatcatttgtattgtttcagaggccttcgtgtctagtaaattttctagctattgatttttgcaaatgtacaaaattaacaattgtgagagagcttttaacaagcttgatttcagttgaaataatatgaacagtaattgttttttttctgttcattgggtaataaaagcatgtatgtaattgggaggccccaatactgttgaaggtaaatctgatgagaaacaaatattcaaagactttgtgcatgcaagagaatcaatagaggcaaaaaaaaaaacctatcttctagagagttgacaggaatctatcttatttggaaattcaaaaggtattcatgcatttctgtgttctgtgccagttacattatttatataataaatgcttttccatattgctttttatttgaaattctcaatcctataactaattattttacttagggaatataactgtatcctttacgccttctctttgattttgtcaccatgatcatcaaaagtttctccccatcaataatccaggtagactcccagccacactcaaggcatcatcaatgatctcagagtactacattggattaattactaatttttcctcattgacttctgttttccacaattcaatatttttctaattttcatttatctgcttgcttcttcctaaagaaggctcatgtaagtttgtatatgtgacaccaatatctctttaatatgtttaatttccttgacgtttctaaatagggttaatttaaatttaccttaagacccaaattatctgaatgcaagtttccaaaaaaaaaagctatatatcaggaattttctaggattcaatttcaaaaacaactttcagagtatggctaataattcaaaggtcaacaaaacacctgagcccactacaatcccagtaccatacaggtcaaaatcaagatttggcaggattgtaggatcccaacgttctttctgatgttaaaaaatatatagtaaataaagttattttttgttcaacagtattttggaagtagtaattgccacattgtatatatgtttgccattagccataaacgtgattttaccaatttattttcactacattgtgcagaattccggaaacttagataaaatattttaacacctaaatatatacacacacaaacacacacacacatgcacacacgctactcttccatgcccccaatctttctctttatctcagagttcaagtgtagccatgatttgacattacaaaatagaaagagtactgttggtttacctgtcaaattacttttatcaagccattaatggtgcttactgtgtgccagacattttttctaagcactttataaatattaactcatttaatctttataaagcctttaaatgatatatgataatattctctctttacacaaaaggaatttaagacactgaatggttaatgagcatgctgaaggccacaccattcataagtggtaaatgggaagtgactctgggccattttgttcccaagtccaagcttttaaatattttcctctgctcttactagacatgatattgctgagaaaagttttggtcccctgtgcttgaatataagtataataattaagtcatcttcttttccatgctcaaattttactctcaaaatcatttttctgtgccacacacattttaacagtttttcattatatacttgttcttctgagtagaaattgactctaaaatacagacaaaaagaaattatatttaagataaagtaaaaaaaaattctgggtgaaggatacattagaatatgtgattcaatttttacaactttcatataagtctaatttctttcaaattataaagttaaaaatctttcaaataattactagtcgaattgaagaatatgaattgaagcagtaccatttagtgcataaattcaaggacacaattttcaagttatattttctatgaacagtcctccctgaagttgtgcaaggagaaagacctaaatcgaagttagtttacctacattaaaatgcataaaataataatagaaaaataaactgaagcaaggacaataatatggattactctccagctttcataactgtgtttttaaatgttcttcagcagaaattattcaagcgttgtttcctactacagaaagaattctcaggacttctcagaaatacgtcagtttttaataataccaatacctgataggagagcagggacaatttcagtgtcattcatagatgttgtcccagaaccaagacagcatctgctccatagtaggtacttaatttgtggaatggataagcaaatcagtgatacatatcgatggtgctttttctactttaaaccacttttaaatgtgttaatatcccattaatagccttctagatttatttgagtagaaattaattcttttatttgatagactagtaaaaggcagcctagacagtttaaattgctcattcaggttcactcaatgaatacacactgaggaaaaaaaatatatatatatatatgtatgtatgtatattcagaaataaagcccagccatgactttttgttcaaggttctttgtactatattccattctttgaactgaaaagaggagaaattatagaagaagcaatgttttaaaaaatagacataaatgcataaatcaggtaacacacttttttggatacataccccacaatacctgaaaaagtagtaagcaaagtcactgatatttaatagaggaatgatctgaaaactttacaaatcaaaataactttgcgctttcaatttttagaaattaagtatttctccttactgaattcatccgtatgtagaaaattatgctgtattatttcaccataagttttaatttaggagtatgggttattatttggaaagggaaatgtttctcaaatttacttccatgttttaaagaataatcctgttaatctctttctcacatcttctcatatatcttatttcacttttaatttcctgtaagcttatcattcctgttaaattactccttgccttttctcagcgatgattgataatgatattgttgagctgtgtctctttctaacacctagactactattcaaactatatcaatcactccattatatttttaaaacctagaatatactactgagatctctcttgacctggtattcctgtatcctgccatctccgatttcccacactgagcacctttccttccttcagcatcctttccaatcagttcagaaagctgcccttaatctgctattctgttgccaaaacaacatcattaatcactttcagttaccttctttgcttcctatacatcaaaacttgagcgcttcctttaccctcagttactgctccactagagctttcttgttttaacgccccatcttcttgtcctgtgtgttttggttttcttcctcttcttacttgatgcccttgttttctttttgtgctattattaccttcattttattttctgtgcatgagcattgcaaattacaaaatcatctctttccccctttgtttactacttatttggttccggtacttcttttattctgtttgtataaatatgtactgaaagcaactgcggaaaaaacacctagatgaattgtgatcctatgtcgtcccttagctgagaaacatttcattcctgagctgtattatttgtcttttctctgaatacatttttttttcatactggctattctcctgtatattctaaacacacctttgtgtaatttaggtgaaattgttggaattataaattgtttagttagtagttgtgaatcatgcttactacagacatgtattatcaaaaatttcacaagaaggatagcgtgatactcaggcactccccacatttcctcaagccaccaaagagttttttgatggatgttcttgtttattggatgctctaaaactagacagacagtaaagattatcttttcctgctgctgaagtttaagtcatttttcccctaacttttattcacacttccaattatgaacttctaacacataaagaaaattgagatttttgtcatgcaatgctgaaacccaaactgacatgtaggaggaaggagcagcagttctgtgggtttgtcaggatgctaaggacatgttgtttttcaaattcgttattagagtcagtgagtttattaggctgaggtagaaaactgtatgctattagtcaaatttaaactaaattcctaaactcaagtcccttatagctcaaaatctgtagattcaagtaaacacttctagaaatgtcctaatatcacattgaaggagatgttcaatatgattttaatttagctgtctaagtctgtatgcaaaaaaaaaaaaaaagaaagaaagtaagtaaagcaaagcaaataataacctcaagtgccaactctaattaattggtagtatcttcttgaactaaaatgtggagaagtcccatctggcctctgtaggagagtgcaatgatctattagccatgctaatagatcagcccaggagaaggaagagaacaggattgttgattgcctgtggaccctgttgtgctagaacatttttcgtatgaaagtctgcatttcaggtgtggtaaattgtttatcagaccacttattttctgatgtgttctactttatttctgatacttgattaaaggtatgctgtgaaagtagtgtagtaataatgactcctaaaatgagtttatgcctctgaaatatagacacacgattcttcttcaataactctgcttatctgcttttagaaagtaagcccggaagtttacggactattgcaatattagattttaccatgtgtgtttattattgataatctaaaggtgaatttattaagctctacattggctaaggagccaaggctaaggattacaattaaacagctcaattatatttagcaagcaaataaaaccttaaattataaagcttccaatgatagcttaaagctcagaaatggccagttttttaaactaagcaataaatatatttttaaaatatttatttctagtgttacacagatgaatttggcacaagcttttcacttccttttgtgaaaaacttgttttgtgcatattccgtccactattttgtgtgtaatactctgtcatatcaaattcgattaattaaacaacctttatgggcatgaaccagccttggtctataacaatttgcaacttcaaagagacaaagtgattttcaaattactgcctaaaaatctatttaatatatataaataagcagaaaaaatatctatagtctttactggagaaccatgcagtagggtggggggagcatatggattttattttggcaagtgaagaaaaaagttattaagacatacaatacaataaaaaagaattcacaacatttagcaacagattggctgtgggtagcagaggctcatgaggagtcgacaacaactttctaagatattggcttagaaaacatgagtgggttgacttacatgttgttttctggagttgagaatgtttttactttgaagaacttttaacctcctctacaagactttttagctacgaggtccccttatcactatgagtaagagaggaatgcaattctgagcagatttctcctaaaactttatatagatagatagatagatagatagatagatagatagatagagatagatatagatatatatagatatagatatatacacatatacatatatatatatatatatatatacacacatatatatttttgagatggagtctcactctgttgcccaggctggagtgccgtggcacgatcttggctcactgcaacctccgcctcctgggttctagcgattctcctgcttcagcctcccaggtacctgggactacagtcgtgtgccaccatgcctggctaattttgtatttttagtagtgaaggagtttcaccatgttggccaggctggtctcgaactcctgatctcgggtgatccacctgcctcggcctcgcaaagtgctgggattacagacttgagccatcgtgcccggcctgtatttttaaaagttgtctttactgaagaggtctgttctaaacacgtattctgtgaggatttgattccatcattttcacacctgttactggcctgacatatcacaatgttttatgagaaaatagaaatgttatgaattcatttttaaattgtatatattgtacaaatttgtattaagcgaagccatggcaggatagcagtctattatttgccttctgtgcactgcagagttccagcagaggtggactttcctccagtttattagagaattttaaaatgtcaaacttcagtcaatagtttatgctgtttctagacctaatataacaaataataacctaatattgcaggtcattttcagaagcagtaaaatgctattatcctactaaaaatttttggagcacaatcacatgatatgaatttcttacacaagcatataagcaataaaaattttacagaatcttaagtgaggaaaaatttgaaaatgctaaaaaaaaaaacagcataaaaacagagatcagaaagtggctttgataattcaacatagaacagcctttagcttttgggctatggctctcaaaatatccaaaaccagttatttttggtgtgtgcgtgtgttttctgattctatttgctcccactcttccaacagcagtcccctgactcttccaatccctcagactcaaaatctttgagtcagtttcaagtattcgtccctttttgtcaattcccattaaatctgcttttgacacatctattcacttttatctttttctaagtgctatcatcctagtgtagggcttcatctccattttcttactaattattttttcaactttcaaagaatcctagaagtgtacacttattaaaatgcatttcatgctttggccctactttaaagcctatactgcattgatttgaatatacacttcggcagtcaacgtccctaaccatctgatcataagctaattattaaattggtatttgatattttaatggcacttgaaaatttcaaagtttccacagttattttattggattttctacaaaaccatctgtgccaggtagtttttattacctatctcttatccaagaggaatataagattctttgaaatttgacaacttacagactacaaatctagcaggtgttagctgtggaacttgaactcatatcctcagattctaaaacagtgtcttagtcacactacccccagtggcttccctctctatccaactctcactgtccagatcatgttccataaccagagttacagaacaattataattaccttccccatccaaaggcttactgtgccacagctcatttctagctgaaattatttcattttgagagatgaacttggacaattaattttggaaatatgaatgcaaaataacttagtaatttaacaacttcagattagtgtagggatagtttcaggagtaaattaaatgttgttgactaaggaagagaaagagaaataatgtgataaaaattattgaaaaggggtatacggtaagccttgtgagataaattctctctactcttgggcttattcgtggtagacatagagctcagaataggttttgtgagatgggaaggaggaattgtatgagctgttattgagagattaaaggttattctgggaagaatacatgtttcagaaacagcaaaaggtgggctcgattcctggttgtcactcattagtcacgtaaatttggttgtgttgtttaacctttctcaacctcagatttatcaataataaaatgggaataacaatatcaccctttctggttcctaaaatactgaacataatatatataaagagttttgtaagaaataggcactcatacataaaaaatggttttattctctaccagcatttgaccttgggcacattatttaacctctctgttcctcaatctacctcttctgtaaacatggggaaaataacagcacctacaccttgttggactgttgatgattcaaagagcagccgccatttgtgatacccttagaacagtgctcaataaatgatataaatgatgtgactaattgataaagacaaaagtcttgtgtttcccttagaaagatgatctaactatactgagactcaatttcctcatctgtaggattgggacagtaatttttcctttaatgttttgctttagtatttaatgagatacgtgacgtatttcatatgcaacaaaatgctattacaatgcaaagagttctggaatatcgaatatgttacaaaatttggggagaaattattagagtaatagagaatttttaacacctaggttggacatttaattcattgatagagttctaatttaaataagattaaaggtttaaaaatccttagttttgtctttaaattttgttatactatcttaaagtttgctaaaaaattgctgtgtctataagtttactagatcatcaccggcaggcaagaccaagattatcatctggatgagttctgtttgttagagatagtaaacacgtgatatctactcaacaccctttgagagaaactcacatttcctcttgataaatgaggtcagatattggtatcatatttaatgtcttcttcaaaagatcgcaatctaagatcactgaaggactttagaatccttgctggcttttgaataatagatttctaaacttaactttgccctgccaaatttatgtatttgttttaatggaatgtatttaagggttccatgtaccattgtgctatttttgcatgcccaggcatgctcggctgagaaggcaggtgaggactgaaatccagccctttgtaaaggcatccaagacacactcatgggattgtgtctgccctgaggaagtagagccttccttcacataaaggcagtgtccctgactaggctgtggccctggtagctgagtccaccctagaggacactttgcctctatttttcctaaacgcgttgctgatatccctcgacttacagtggggttatgttccaataaacccaccataatttgaaaatattataagtggaaaatgcatttaatatacctaatctaccaaacatcatagcttagactagcctaccttaatcatgctcagaacactgagattagcctatatttgggcaaaattatctaactcaaattctattttataataaagtgttgagtatcttttattcagtactgtacttaaagtgaaaaccagaatggttgtatggatacttgaagtgtggtttctactgaatgtgcactatttcataccattgcaaagtcaaaaaattgtaagtggaaccattgtaaatcggggattgtcattatatactttagaggtaggcctgaatgtgatatagataaaaaattgattgtatttttaaattgtatttaaaaattgaggtatgcaattcctcaaggatctagaaccagaaataccatttgacccagcaatcccattactgggtgtatactcaaaggattataaatcattctactataaagacacatgtacacgtatgtttattgcagcactattcccaagagcaaagacttagaaccaacccaaatgcccatcagtgatagactggataaagaaaatgtggcacatatacaccatggaatactacacagacattaaaaaagatgtgttcgtgtcctttgcaggaaaatggatgaagctggaaaccatcattctcatcagactaacacaggaacaggaaaacaaacaccgcatgttctcactcataagtgggagttgaacaatgagaacacatggacacagggaggagaacatcacacactggggcctgttggtgggtgaggggctatgggagggatagcattaggagaaatacctaatgtagatgatgagttgatgggtgcagcaagccaccatggcatgtgtatacctatgtaacaaacctgcatgttctgcacatgtatcccagaatttaaagtataataaaaaaaaaattgaggtctgcaacaggcaaagccactaaagaaactcagatatttttcattgtaatgttgaaaaagttatgaaatttcactaagcccgtgtctatgaagtgggaaaataacagtgatatgaatattatatgagaacatatttgtaaaatatttgttgtatgatagatacctagttttgaatgttagctatcatttttggctcttataataggttattggaaggtaggtgtgactcctatcttttaagcatgcagaatactgaagtgataaatttcatcattaattttcagacctttgacacttacttcggtgtttaaaaatattgatgtatgcagacagtttatctcctaaatatgagggaatgttatcatgatcactcaaaggatataccataactcatctgacatttaaaatgtcagtttgattgataaatgagagtcctgggtagatgaatgtgatttaaatggggtttggtttgcatacagaccaaataaataatgattcagttctgaagactggctagactagggctagggcaattaattggggtgctgggacatgatatctgagcaacagatgctaggttatgctgctttggtcaccaacaggcctgctccataacaggcaataggtacatagacctgacatttaagagcagttaatgtaggcctcaagaccttgaatggtaattaactaacatgaagaaatggaacagagtgtcaggattatctattatggcacaatttcctattctgagcatgcccagtggtgggtcagaggggaggtcaaggaacagatgggatcaggaagtaaagagagctctttccagctaggacaggcctgaggggaccgaatagacaatgcaaggcagagaatgagtcacaaggaacaaagaacctggcgaaaaccagagccacactaggtttctgatgaagctggccaccatgggcttctctcatttaagacactctctcaatccctcacgttcttcaggttggcatatgactgaacttaaaggctggagagctgcagcctacatgaggctagcaaataattaatgcattacagagcacttaaaatatgatacagaaatatacaattctgcatgtaaatccaagtattatgaaggaccaacacagaaatatataggcaataatattatgtgaggccataagataatgactttttattataataattatgcctgatctaaatgagctatgtttgatttctgtgtactttcatagctttatagccaagcatgacttctctgcccagaaaatcctgcctgatttactctttagcttctctctaatttactttctttttttgagatggagtttcactcttgtctcccaggctggagtgcaatggtgcgatctcagctcactgcaacctccacctcctgggtttaagcgattctcccgcctcagcctccagggtagctgggattacaggagtgtgccaccatgcctggctaatttttgtatttttagtagagatggggttttgccatgttaccctggctgtggtctccaaccctgacctcaggtgatccacccacctcagcctcccaaagtgctgggattacaggcgtgagccaccgctcctggccctactttacttttaccagctagggactgtttctcattcaatacatatatttgtttgtctgctaagttggatgtagtagttgagtagtggagttgaaaactgagagattgacagcagtcagttcattgaggattgtgttatcacgtgcactgggttagatagtgcaccctcaaaattcatgtcttttctggaacttcaaaaatgtggtttttgtttgcaaatggggtctttgcagatgtaattagttaagatgatgtcatattggagtggggtgggcctttaatctaacatggctgatgtccttataagaagaagagaagaaatacagagaagacacacagggagaatcccatatgacagaggctatcccgagtgacgtgtctataagccaaagaatggcaaggattgctggcaataccagaagctaagaaagaggcacggaacagactctctcctagagtattcagtgagagcatggccctgctaatactttgattttgaacttctagccaccagaactgggagacaatatgtttctcctaaaaaacaaacaaacaactacaaaccctacccagtttgtagtactttttaacagcagccgcaggaaactaatacatcatggaaatgaatttaaacatcttattatctataaagaatgtgaactgtcaaagcttactgttccattggacatcagtttcgtgtatcttttatcgtataatgcatgactagagtaataatttcaaaggacattaaaaaatacagacattttcttgaaggtacccaaacgtttgaattgtgggtcaggccaatatcagcaagggcatttgatagagtttctcacaataaccttctgtgcatgtaaataactgtatcttctcaatagatttgttattgtatatttggtcttgtagacttacccgaggaagtcagataatagcgtatttcgatatactgtgagaaaaataggtacacactaaataggagtatgaaaatacacaaagaattacccatcagcaagagcacattatatttgtttttcttgaaacacccattctttcctccttctactttgttttatttttaatctggctctcttgcttatcttcaaagttttatctcccccaataaatcttcctgccatggtgaaggttaaatgtaactcttccatcatccacgctagcacataccatatgcatagaagttataaagtccttgaagacagagactctattttacacatctttgaattcaaagccctaaaatatttgagccctgaagaagttgttaggacattttagccaccagtgcatactctagtagtgacggtagtgatgtaagtacattcctcagcttttctgaacattagtgaagaattccttttaataaagagcaagattttccattgatactcagatggacaagttttggagtattctcagagatgaaaaaggattatttttcatttgatgtacatgtattctgtgattttgtgaacacaatggatgcttgctcttttcattattattgttattcctttgggtaaggcctttatgttgtcaaaaacttctatttaaaaaaagtgaaaataataaaacattcagccatttgcagtcaattattcttgccactggttagtatatttatttaccagggttcttaattaatgttactgagaggctcaaagatctgaaaaacagcattggttccaagtggctgcatttctttcttattcatttatttattttttagaaatgaggtcttgctctgtcacttgggctgaagcgtggtggcgcgatctgctcactgaagcctcaaactcctgggctaaagtgatcctcctgtttcagcccatgcctggttaatttttttttttttctttgtagagatggcatctccctgtgttgcccaggctggtctcaaactctgggcctcaagtgatcttcccaccttggccttccaaaatgctaggagtacagatacgagccaccatgcccggctagctggctgcatttctttaaggcccagagcctcctgtggtagcatctggatttgaaatgctggctgggtgcagtggttcaaacctgcaatcccagcactttgggaggccaaagcaggtggatcacctgaggtcaggggttcaagaccagcctggccaacatggtgaaaccccatctctattaaaaatacaaaaattagctgggtgtggtggcgggcacctgtagttccagctactcaggaggccaaggcaggagaatcgcttgaatctgggaggcggaggttgcagtgagctgagattgagccactgcactccagcctgggtgacagagcaagactctgtctaaaaaaaaaaaaaaagagaaaggctcataaacattgtctatgtctaagctgcaacaatgattgatattgtgaagattattaatagtgtgggtcaactgaaggggaaggaaaacaccaaaggagaatttttccctcccaaatcataaaggcattcatttttcagagaagaagagaggaatattactttcattaaaagaataggaaaattaaaattgttgttattagccacaaatcagggtagagctgtgtgaatccatggggagaatgtaagattataagcagaaatcaaggttagttttgtcttgtacttctggaataagaaagatgatatgtaatcagaccatgtctctgataattttgttaaattagatgaagaaaatcacatggataagaaaatgtaattaaatcactaaaaataagaatgtcattgttttcactttcttttgctaagtaggaggtgaggaaaataaccttttactctgtacatgagtaattccaatatcctcttagaaatgacaattggattgtaaaatgggcttgcctttgaccatattctgaaaggataatataatgagttggcaaaagaccccatgaatagagtttatgtagaaagcaacaaaaaaacacaaatataaagaaatgcctacaaccaaaggtcagtataattgatagcaagatttcaaggggaaaaattagggtcagggaagatataaaatttctgtctccttgttttggtgatttttaatctagaaataaaacaggaatagtgaaatattccatagtatatctaaatatccatctttgtggcagggagctagaaagattcaggattattatttataaaccaatttagactaaattcaaagactgaggagatacacctaatttagaagaaacaggagctctgagacctgactttgcatattactactaatttttttcttagtgctcgttttgctgcccaggctggagtgcaatggtgcagtctctgctcactgcaacttccgcctcctgggctcaagcaattctcctgcctcagcctcctaagtagctgggattacaggcgcccaccaccacgcctggctaatttttgtatttttagtagagacagggtttcactgtgttgatcaggctggtctccatctcctgacctcaaatgatctgcctgcctcggcctcccaaagtgctgggattacaggcatgagccaccgtgcctggccagggcctttttaagtattattttttcttctaaagttactgatgctcaaatgaaacctaattttgaaaaatagaatgtttgaaagaaatagattgaatgaaaataacacagctgatatttttagcaagattcttggatatagctttagaaataaactagccagaaggagcagtatggcaagattaccttttctttatatcaattagacatattgtatcgtatgacttatttagtactgaagatgtctgtgcctttctgcagttgtttttcatctattaaaagagaaagatactatctatgctatcttttcaagatccctgtggatttgaattttcaagtgtatagataaaccttgattgatgaaaaattgatggacaaaattaattttataacaaaggtaaagaagtgagtattgccttcataatgtgccccacagcttttaacagaatttctttaaacaatatttaatgtatttttaaacaattatatatttcaatattaaatcttaagtatgtttcaggaatatcttctttaagataattgatatatcccagttttcatacgttttaaattttttacgtctacagtattatattttcttttgaaaaattgcgtaacattaaggtagtaaataaaaacaaaaatagtttaatgtctcttgtgggaaatacagttttgttttgttttgtttgtttgtttgttttgagaccgagtttcactcttgttgcccaggctggagtgcaatggcacgatctcggctctccgcaacctccacctcctgggttcaagtgattctcctgcctcagcctcccaagtagctgggattataggcaatgcactaccatgcccggctaactttgtatttttaatagaaacggggtttctccatgttggtcaggctggtcttaaactcccaaccttaggtgatccgcctgcctcggcctcccaaagttctgggattacaggcgtgagccaacgccccctgcctagttgtttttgaccacatattttttctctgaaatataaatgatttgtagcccaaaagtttaagtctgaatcaattgtctgtagtaaatgctgcaccatctacatttgttaatgagaacaatacagaactaacttgaaaactgctcaaattttcccttgcataatgctcagtttttaaaatgtattgccttctgtcttctcaatgggattgctgctttttaaattttcattaattcctaaaccatattccattgtattttttttgtacatttgctttaagtgactgtctattggaggaaaagaaagtgtaggttttctggtgaattataatagcaatatgattcctggaatgaagcagcttttctcgtttggaatgaccataaaatggcaatacacttaacagtaatacccttgtctgtgttacagcaatgggtcttaatggttttccatacgtgaacttagccgcttgcctacagagaattactaagtaactagtatattccacatgtaaaaatctccagagggcttccacacactttaatacacgctgatatacaatataaatgcaacgtatcctgaagaaaaaaaaaaatcacaaactccgtgtgtggctctcaacaagctactattttctcattagaaaaataggaaagctggccaggtacagtggctcacacttgtaatcccagcattttgggaggccaaggcaggcagattacctcaggtgaagggttcaagaccagcctggccaacaaggtgaaaccccttctctactaaaaatacaaaaaaaaattagccagtcttggtggtgggtccctgtaatcccagctacctgggaggctgaggcaggagaatcacttgaacctgggaggcagaggttgcagtgagccaagattgggccactgcactccatcctgggcgacagagggagactctatctaataataataataataataataataatagtaaagctaataactatacaatatcttacctaaatgtttaagaacacctactaataatacttaaaaataccaaaatataaaaacaaaacatacaaatgtaaagaacatacagtcagtagtacagcaaatctatttgattacttttttcaaaattctattttaatttttttgctaattttaaagcactgttattaaaagaaaatattttcaattggttttattctcattgtatcttctagaaatactagttcattttaggaaaataaaaatagtgagagaaaacttttagctctgaatatggaccatgtcccatgcctgccactttgttctagtttttgttatttaattatcacacactataaaggagttcttaccaattcttttttttcttcagaaataattgattcttcagttttttaaactgctttattgaggtatgattggcatatacaccaattctcttttataggcaatgaaattggagatcagaaaaaattgagtaacttacctaagactacaagtaagtggcagagctagaatttgaccccagacaggcttcacatacaagttcacagggccatcagctgcctgaaggcagagaccatgatttgtatccatagtatttatgtatctctcatatctaaataaaatctagtcactattcagatttaattgatattttcaattacctttgtatttttaaaagaagacacattatagaaatttgatactaaatgtaagtattcagttctttagttaaattgaagaaaagcagaaataatattctgtattaatacattagtgaaaagtcagcagctaaaatgtaagagatgtttggtgacacaagtaaaaatggattgtatactttttgccttatactacctgactctggcatttagatataacttgttccagagacctgtcataacttatatgtttcagacaagaaaagctttgggttacctgaaatagtgtagttaaaaatcaaacgctgtactcatctagagggactttgtttatccattcaaaaatacatgaacagggctttatcttggcctatttgaactccatgccagagggcagcataacatagcaaagcatgctgacctctccttatcactgcccttgttgaaaaccttgagttcttcttaatagtctggtatatagttttaaaatgttgatattttgttcacagctatatgtgatctcctaaacctttgcttcaaaatagtctatttctctgttgtggtttgcttcagggtaaaagccctctgatttcccacaatcaggacagtaatttggtaggttaataagttatgttgtgtgttagtgaaatataagtgctaaggaaaataaaagtagtagggcaagggaaatcaggaatactagggcctggaaaagagcatgaaataatgtgttatgatgagttgcactgagcaggttaaatcagaacgagacaagaagccaactagatagagaagattgttccaggttaagggaatgagtggaaaaaaggctctcaggtgagagtgtgttcaaggaatagcaattaagactgtgactactggccaggcgcagtggctcccacctgtaatcccagcatttttgggaggccgaggcgggcggatcacttgaggtcaggagttcgagaccaacctggccagtatggcgaaaccccaactctactaaacatacaaagattagccgggcgtggtggtgcacatctgtaatcccagctactcaggaggctgaggcaggagaatcccttgaaactgaaggcagaggttgcagtgagccgagatcacgccactgcactccagcctgggcaacagagtgagactccctctcaaaaaaaaaaaaaaaaaaaagactgacttttataaggaagaaagtagtaagagatcataaaatcaagaggatttggtggtacagattagagacttgtacgttttcgtttctgtgcagtagagaaagaacacagagacatttgcaaaacaatttaagaggggattccttcaatacttttctaatatccctctcccaaaggcctgtttattcttcagctaatttttactgataatttgtattttttagaaagaacgcatctctttattttatagtcatgtatcatcaaattatgtagtatataattatattagatcattacatgagcaggaatgggaacaatcacagttgattcttgctatgttccggttatctattgctgagtaacaatttattataaaacttaatagcttaaaacaccagtcactttttatagctcatgattttgtgggtcataaatttgagcgtgggtcaactgggtgattttccactctatgtggtatcaacttgatccctaaatgatactcagctggcagatgagctggtcagcagaatccaagacagctgtactcatatgtatgttgctttggtggagacgacagggagacttgggtcaactagatctattgactctagtacctacatgtggcctcttcagcatggtagacccaggattgttgaacttatcacatgggagctcagggttctagagtgaatgatacaaaagacggaaaatataagtttctggtatcttcaggcctaaccctggaaactagaacagcagctctttcactgcaggggtccccaacccctgggccacacaccggtacccatctgtggcctgtgaggaacccagctgcacagcaggaggcgagcggtgagccagtgaagcttcatctgtatttacagccacttcccattgctggcattactgcctgaaccctgcctcctgtcagatcagcaatggctttagagtctcaggagcacaaccctattgtgaactgcacatgtgagagatctaggtcgcatactctttatgaggagtatcaggcaatctagtgactgatgatgtgtcactgtctcccgtcatgcccagatgggaccgtctagttgcaggaaagaaagctcagggctcccactgattctatgatatggtgagttacataattattttattatataatacaatgtaataataataatagaaataaagtgcatgataaatgaaatagtctccaattatcttaacactatccctcacctcccccccactaaccccagtctgtgggaaaattgtcatccatcaaaccccagtctctggtgccaaaaaggctggggaccactattctactgcattctattagagcagccacagaacccacccaaattcaagggaggaaacaaagactttacctccccagtgaagaaatgtcaaaaaaattcgcagctatctttaatccgccaaagcatacgatttatctctcatagagagatttctagttaaggtttttcagcaggtcatcttgatccatagtaaatctaacaaagggaatggagagctttggttaatctaatgattcagttaaatggagatccattaaaatagattctactataattccattcattatttttcacattttttctaattttttattattcatagtgtttttgtccaatgacctttaaaatcatgaacatttaatatataggaatggcatccatctgaatatggcataattataaatgaatttactttaatatctagaaaacattcttgttcgttctctaacttttagataaaagccatcccttcttttatttaatttaactctactttaaggctttaaaaacctgactgatagggaaaaagtccaaaactgggacgctcgtgtagactatttactgcaataaatcattgtgaaaaatatgggcagtcaagtgctggatattctatttctgtttgaaccctaagaaatatcaaccgtcttctcactggcttttagcacatctgctccatttaaaactatggcagggaggtgtgtaagattgaattgattgtctcttggagtttactgtgcttctttcgaaactttgtttttcagtaaaggcaattgcttcttgagcagtactggttattccacacccactaattatcatgcagccatttagagttgaaatggtaatcaaaccaatgaaagcccaagattagcagcgttccttcttcatttctggtagagagattcatctgaatatctataaaggattttgtggtgcattctctggcagatgcagtaaaacaagtgcaacatgaactttaaaatacagctttgagttttaggttgaattttaagttgaacatatttcaaattttgcaatttaattataggagttaaatgatcttaaaggatcattctaggtctgaatagaattttaagagctagattttattaaagaaaagatatattttaagtgataaaatttatatattttgcccttcagaaattactggttgatgtttctattaaaattattaagatctaaatatacaatgatactcgagaccaattctcatttaaggaatggcatactgtatgacaggatgtgaggtgttaagagataattacatgcctagaaggtgtagtgaatcatatgaccaaaagccaagaacatccagagaccaaaattcacagtcatttcaaatatcattactccctggtgtgtgttattctacttagaaaattgcatgtttgttgtttgtaaatttagagacaaaaaatgcttaaattaattttttcatcatttctaaaaatttgctttaatatttactagcccagtaaaatgtattcaaatcataattataaatatcagggctattgagcaggggaatgtgtcaactgccattccggaccttcttctggaactaattttgattgccagcagaataaaatgcatgcaatgaatacaatgaatgtaatgctaaatcaaataatcaagtgtttatgtttatgtattttgatccccctatacatttaaaataactctgttttattagaagttctgtatttgagataaaatgcacctccctctcatttttcctggtttgtatgtgagaccacagtatttcacagtagatatccagggaaataacagacaaaagaaaggagagcaggaagaatattttaagatttattggccagcggcggtggttcacgcctgtaatcccagcactttgggaggctgaggcgggtggatcacaaggtcaggatgtcgagaccatcctggctgacacggtgaaaccccgtctctactaaaaaataaaaaaattagccaggtgtagtagcacacacctgtagtcccagctactcgggaggctgaggcaggagaatcgcttgaacctgggaggcggaggttgcagtgagcagagattgagccactgcactgcagcctgggtgacagagcaagactcgtctcaaaaagaaaaaaaaaagatttattaatttgtcttcaacaaaatactaactctgcagtgccctcaccttgattccttacttattgaggactaagcctatttttgtggattgaaatgatgttaattatctgcatccaaatacccctcataggggcgactgtgagcacgtccctctactagtaacacaatactcaggtgagagctggcaaacacaggaagactgaaaagcccgacttggaatcctgacttctacattttttaactgtgtagttctgggagtttcttaaactcgtgtgcctcagtttttccatttgcatctgtagaaagattgtaatagaaactaccttctctgttataatgattatatgagctaaagcatgaagaaatataaagcagctaaccctgagttagctctcaagaagtattttattattaacttgttaataccttcaacttataaaaatttaaaaattatgaaattttttaaattatgagatttacataaagttttcagaatagtctaatcaatacagacagaaagtagattagtagggcctggggacgtggagaaaggagagtgattcctaatgagtatggggtttcttttttgggctgacgaaaatgttttatattagaaagtggtaacagttggccaggcgcagtggctcacacctgtaatcccagcactttgggaggccaaggcaggtggatcacgaggttaggagatcaagaccatcctggccaatatggtgaaatcccgtctctactgaaaatatatatttaaaaaaaatgagctgggtgtggtagtgcgcacctgtagtcctagctgctcgggagactgaggcaggagaattgcttgaacccaggaggtggaggttgcagtgagccaagatcgcgccgctgcactccagcctggcgacagagcgagactctgtctcaaaaaaataaataaataaaggaaaaaagaaagtggtgacagttgcataactatgtgaatatactatatatcactgaattgtgcactttaaaagagtgaattttgtggtgtgtgagttatagctcaataaaatgattttaaaaaataaaatgagaaggatgagagaccggtatatttcagaatagtgcacttaaaaaatttgtttacagaacactaattgttcagcatactttctactggacattactgtatatatatatatatttagtattatataaatacattatatgataaccatatctgataaatattatcttactttatagatgatgaaactcagatcttcaatgatggaagtgacttatctattgttgagttgtaattggatcttatatatatttccctgctcccacagagcctacatttctgaaaaagaaattatgtctcttgtgataaataaacaagaaacatatcagataaaagtgttgcattgagaacaaactgagttgagatagtgagtgattgggtagttattccagcttcagtagtaaagagaatctttgctgaagaggcatgtcagctgagatatgactgtctagaggaaccagtcatgtaaaaactgaggaagaaccttccagaaggaaagaatagccagtgctaagacactgaatttcttatattttgtgtttagaaatgctagggttatagttagcaagatagcctggaaggagccttcccatgttttctcatatatgaaataactaacatggaggattattgtgaagttacaaaaatacatgaataacacctagtatagtatctcactcgtggttggtatataaaaaatattgctgttctattaattcctcaatatatagctattctatacaggtcttatgcaaaaaagaaccttagtgaacgtatttcaacttggtaagagttagttacacatgggctgacacaatcataagcatggaaaatagacaatagattgaaagcattaacaatggtagttggaacttcagaaaaacccactctttcttaatctatgatgaaggaaatggtgggttttccagtggtattgaaataaaaggaaactttttagatggtggagtaaggtatgcaaaggtagcgagcgtgtgcatctatggctggagagaaatccaaagacaagatagaatcacccttttgctctctgtgaaaactctgattttcctttcatggactaaggtctacactctccaatcatcttagttgcatacactattaattcatcaatcaagctacgtcatcctttgtgatatgttttgtttttctttcttctttttaattattgtgggtacgtaagagttgtacatatttatgaaatacatgtgatattttgatacaggcatacaatctgtaataatcaaatcaggataattggaatattcattacctcaaacatttatcatttatttgtgttgggaacattccaagtctactcctccagttaatttgaaataaacaattaattattgttaactataatcaccctattgtggtacagaacactagattttattcctactagctaactgtatttttatactcattaaacaagcccctcttcatcaccccctccccactacccttcccagcctctggtaacaatcattccactttctacctccatgagatcaattttttagctcccacatacgcgtgagaacatgcaatatttgtctttctaggttgtgttttgattagacaacctcttatttctaaaatttgcttaaattatttgagtacttgatccttcacattactgccaataaagcaaaccacagttgaaacttgatttttttctaatattttgaatgtatgctgtgtgcaaaggtaacaaagaggaatccatttaacagaaaacagattgctaatatcttcatcatttactttagattccagtctttggatatcagatttttctctggtcttcatatttatttgttttggcatcagattgcattttcttgcttggtttaaaaaaaactgtatttttttccctgtattatcggtgttgatttcctctgttcttattcttcaaattatgcagagaaatgtgtacaaagttaggaggagttaacgctatataaaataaactatctattaatatcattcggttaattttcaaagaggctgtaaatagatcatggatataggcaaataccagatgccacataaaaggaaaacctcaaagacattttttcttttattaaaaccatcaacagtaagaactgtgacagtaggttttgggtttttttattgccaaggttattatcagccctctaccctaaataagggaataaaatgatttctagtttttggacactgtgttatattattctgtaactacaggaacataatataatgctacagtcaaaagaataagcttagaaatcatctaagtttaaatttgtcactcattttctagaaggatgaccttatactatctatttaacctttctaagactcaattgccttataaataaaatgattataataaagacttcataagttgccatgagaaaagtattaagcacagtttctgagataaccaatattgataataatataataatcatcacaaaacattacctttctccttgtaaaaattataacgttaatggttttaaaaatgtaattctagtaccaaagtgaagtttgtattatgttctagttaatatatataaaaatttaaagaaaaactaaaatacatatagctgtgaaaatactcactaaaccaacatagaaaagcatttgttttgctctgtaaatctaaccttgatgattatgataataaaaataatcactgttaggttattttacttgtgattaacttctatttatgtaccctccctctattgatgtttaacaatagttcatagctatgactatttcatttcatatggctgttcctaaaatcatactgaacatctgactccatattcttaagacaacttgggacctctatctcttccctgcaacaatatttgtgagttgacaaacataaaagcctatgctttagcacgcacaagagatgtggaaaggtaccatttaaattagtaccataaattttcctttttatgtttcctaacctcatatttattgaaatgcattaaattaactcagacatctaaggatataacatttaatttacaataatctttatggttacttaattccattaaccttatctttgaaaggcgtcaaattaagaaatacagagcctgtcactttcatttattcgggggaggctgtgaactattcagatgatgtatctttgattgagggaaggaggtgcccaagaattagtcaattacgcaattaaaaaccccaaacctttcctttggtatgtttcacacaaaatctccattgctgtgctagattacactggatgatgaatcactacttgaatcacttcagttttgattattcaaagtaaaaattgaatggttggcattttcaccaatttaaaagcctcgccgggcacagcggctcacgcctgtaatcccagtactttgggaggccaaggcgggtggatcacctgaggtcaggagttccagaccagcctgatcaacatggtgaaaccctttctctactaaaaacgcaaaattagccgagcatggtggcacatgcctgtaatcccagctacttgggaggctgagacaggagaactgcttgaagctgggaggcggaggttgcagtgagcggagattgtgccattgcactccagcctgggcaacaagagtgaaactccatctcaaaaaataaaataaaataaaagccttaactttcattttctcaccagattttagcttgacaaaagctatctttaagggttgcttaggcatttcagtttgaaatgtttatgttcttgctataaaatgtgtggacatgtgtgtccaaatatatacacacaagaaattttaggtactgtcatagtgttgggatcattaagaattgtgttttcatggcgagtaaattaatttcctctgctgtgagtcactttttggtagtgtatgcatggtttaaatgaaactcactgaactgtttttgtggattcactgcttggttgttttactaccctagagagcaattaggtgtatgtggagtgtgttgaacctataaaattttacttgtgtgatgactgcaaagaaaatgaaagtagtgtcatgcaatccatgaaaactctgctgagtttctagctagtctcttaataaagtttacacaattcaaactctccaatcatactgaatatcactgaggctcttaagacttgtgaaaatcagatattttaaatttttaaattgtcatattatgtcgccaatttccatttctactctatatttatagtacttttttgcattttgagtgcacaagtcaacccgtttggccatacatagcaagacatgtattggtgagagcagcaaaaaatatgtaactgctcgtttacaacttttgaccagtagcgaggtcacactgagagtaccgctcaggagaattgagtcaagttttaggctactaaaatttgctgagctctgtgacctagggacatattcctgactccagcaggcctttgaagaaatcacgctggcaacctcacaatagatgaacaagaaaatggatgaacacaaccatattataagaagcagttatcagacgcatgggttctggagccaggctgtttgctgagttcgaatctcagtgctgctatttaatgactgtgaccttaggcaagttgcttaactctgcctctcttaattttggaaattaggaaaagaactacttacattttaggtttgttggaaagatttatatcacttaaaatgtatacagcatgtaacaattattgaattatacttaacaattattatctaggggaaaatatactgatgattttgtatattgtatatatatacacacacgtatatatcagtaactttaaatggggaagtcactaaaaaaatcataacttggtgtaaatatacttaatctgtatgccacggctagttttttgtttgtttatttttgccaagtttctttaatttctgttggccttttggggtcaccccattagcatctgcaggatagcttacttatacaggggaaagtgtctgttaccagtacagtacagtggtggtataaggaaaatctattaaatgaagtcctgggtgtttatccctataattgcataaatgtatgtttctcaggagtagtgttgtgtaagtaaatggataaaagtcatagagtgctaaagctaaatggaaacaaagttatttagtccaattcccatattttatagatgagaaaactgagaatcagaaaatggagggatttgttcaaggtcatagtagttattgtctgagatgaggaaaatatccaaatgtctgcttaaatactgagatatgcttaagttagcgttgaaaatattccatttaaaatagcaatattttcttcctcctgaacatctttgtactatttagaaaaacctagaaagcatgctggaaaactatccctttttcccttgtcaacctccaattaacacaaaagcccaaactgtacactgtcccttataaaaacaacctaaaattttgagaataacattcataatcttaaaagaaaattacctacttactacatatgctggcaatgtacttgctgggcaatcccacttgaaattcatagaaattaaacagcatttcagaacatcattccaacacctaattaatgacagggagtgactgctgactaaagaatgtgtccatgatactttcaatttatagcaaaaactcttaactattgatagcagaaatgtgatatataaggatcttgttctgtcctttcaaaagtcaaacagaaccactgtcccttaaagctgatcggcaaaggaagaagctgggagtccaaaggatttatttatacaaaatatgtatttccctaatgttcactttccaactttgattagacattttttttttttttttttttttttttttagcgatggggctgtattagtcaattctcacactgccataaagaaatacgcaagatgaggtaatttttaaagaaaagagtaattggctcaaagttccataggctgtacaggaagcataatgctggcatcttctcggcttctgggaaagcctcaggaagctcaaaatcatggtggaaatgaagggggagcaagcatgtcatgtggccagggcaggaacatgagagagagagtgggaggtgtcaaacacttttaagcaaccgtatctcatgagaatacactcaccatctgaagacagcaccaatgggatgatgataaaccactcgtgagaaatccacccgcatgctccgatcacctcccaccaggccccaccttcaacactgggaataacttaaccgggcgtgatggcaggtgcctgtaatctcagctacttgggagacagacgttgcagtgagctgagatcgttccactgcactccagcctgggtgacaagagtgaaattccgtctcaaaaacaaacaaacaaacattggggattacatttcaatatgagattatggcagggacaaatattcaaactatatcaggggtctcgctctgtctcccaggcttcagtggcaccatcgtaactcactgcagcctggaactcctgtattccggcgatcctcccacctcagcttccccagtagctaggactacagttgcgccaccacatctggctcatttttgtagaaatggggtctccttatgttgcctgctttggtctcaaactcctggccttaagtgatccgcccatctcggcctctcggagtgctgggattacagacgtgagtcactttgccctcccggactggttttatgtgtgaaggaggctgctgctgatttcatgagtaagctggagaaacacattaaggaatgatactgtccccttagttgtcaaccttcaaaataggaaacaaataatagcaaagaggtaaacgtggcagaaagcaggggtgagaaagggaacaatcagatatgcgaaacatcaaagaacaagaaatagcaacaaacccacgccagaagccagcaagaaaaggagaactgttataagtaccagtaaaaatgctgaagaatggcaataaaaaggagaaaaaagtactcacaagggaggccttgaaatgacaataatctattccaggatgaaaagaaaaggaaacactactccaaggcaaaaagaaaataaaaagtaaggaaaatcaagatagatgaatatcttcaaaaaatcagcacaatggagatagagtgtttagggaataagaaaaaaaataaaagtagacagatacagaaagaagtagcaaatgcaaggagcaatatccctattattaatgctggcaaattgtacttatatctctttccagctatatagcatgttcctgggaaatagcctaaagcactgagaattagggataggagaatgctgttactgtgagaatacgaattaagtaatgccagagaaaggctttgctgccaatataatagctgagtgatcaggccacgtcatttctgtctgatgtttcttcctgtcgaataggtaatagtattatttctctaactcaagggacattaaaaaaatattcagttaatgtatatataaatggagacaatatagacagatgtttaagaatattttggttaaaaggacagactcaaagccaaactttctgggttggaaatccaactctttcattttctctcagtactgtactgtaggactctctttttatacactttttttgtactgtcttttttatacactgactctcttttttccttagtttcttcatctgaaaaatagagttaataatagcacctacctcataggattgctgagatgagaaaattaacaaataaaaatcacttagaccagtacctatcacatagcaaggaaaatctcaactatattcattgtggtgatgttttgttaataaacttttaatatgaatgtaacatatcacattcattaatatataggaattatatttacttacattgataaaagtcctatctgacatcatcttctgttccttcattatttttcccttcttcctcactttttcagttctgtctctcttggttcattccaaaaaagggtcatttcttttttgcctcaactgcagaatgcatattatttatcaagcaattattgagcacttaccatatacaggcactgttagaaagacatctaaggcacaattttttagtgtgctgaaatagttattcattcagcaaaagaaggagctcataaaaataaaaaagaaatgctatgggtaaatataagaacatggtgatttcacttggtcctcttggatgtaaaaggaagctttaccaaaaatgttaaaataataattgatggttgcagtgctgctgaattacatcaaactttctattgtctcacatttcactttctaatttgtccgttcctagtgaaactagaagctgaaaccacatttttactcatttctcccgttatcctccccccaccactataaaaagagaacatttatgcttaagtgcttctgatgatgtgttctcagtatctcattctgttagactaatagtcctcatgccaagttaaagtggttggaaatcctagcacaccttgcctaagtgtgttttatttatcttgctacaccccgttttattgtaatagtcttgggagagccccgaaagatggcattgacctatttctataaactttaagggagcaggggacgatctccctccataacaaattccaataaatgatgaggttaaaaattatagaaaggatatttctagagaggtatttttatgtgataaattttaatatatatgtatatagtttttaaacttgaatatataaaatatatactaaacttgtatatttatatatgtattaaacttgtaccacttaaaaattcttctgtagaaatatcttttctataatttttaacctcatcatatataatgatggtaattcttcgtacttcttactcctaattgtcttagttcaattgggctgctataataaaaatatcatagactgtgtaatttataaacaacgaagatttattgctgcagaactgtttctgcagcccaggaaatccaagatcaaaatgttggcagatttggtgtctggtgagggttctgtctgcttcacagatggtgccttcttcctttaccctcacatactggaagggcaaacaagttcccttggcctcttttataagggcactaatcccattcatgagggctccgcttatatgacctaatcaccttcttaaaaccctacctcttaatactgtggcattggggattatgtttctacatatgaattttggagggacacaaatattcaacccatagcactaatgaaatacagcatttttagagagcaatgtctactattttacaggcagcttgctactcgtgatgacaatacttcttcgatctagtatcccagcattgttccattaacaatgtatgcatcttaccaatgtaatgttcagtaaatattttgcatattttaagaggaatctgttgtggttttttttttttttttttttttttttttgagacggggtctcactctgccacccaggctgaagtgcattggcttaatcacagctcactgcagccttgccctcccagaccacaggtgcgtgccaccacgcctggctgatttaaaaaagaaattatttgtagagacaaggtctcactacgttgctcaggctggtcttgaacttctgggctcaaccacccctctggccttggccttccaaagtgctgggattacaggcatgagccaccaaacccagcctgattttttataatacaaaataatatacactcactgccaaaagtagaatacagaaaaacacaataaaggtaatagttgcctataattttgctattcaggaataaccagtgttacctgtttggcacagacattcctattgagaactatataatgatagctaatatttactagcacttggtacatacccatgtttcaattaccttatatgttaaatattatccatttatgcctgaaaataattttataatataagtactgttattagaccattttaaaaatgtgaaaattggtgcaataacaagatgcattaacttgttcagggtcacaatgccattataaaatggagccggaattctaaaccaggcattcaggctccagagcctaggtttttaaccactaagaataatacattttagtattttagcatacacatagttttggaagctgcttaattcacttaatatatcatatggttttccaacgtagttaaatattccataagaatgtgatttttttatgtctgcatataaatatattaataggatgtaccagaattgttttcatttctatttcatgaatatttagtttgcttctaatttttcacaatagaaatgatctagcatattttataaaatttttgagcagatgtacaagtatttagagactagtatttgtttaaataacacgtgttggacgttagtggggtatatatcaatgtgaaacatgaagtagatgtttgctttgtggtaactatgttccaggaacagtgctaggaagcactagggactggaaagctgtaaaaaagccagtctttctgttcttaaatatcttataatctaatggagagagaaacctgtagaatagtgcgtttcagtagaagcaagcttagtgtactgagaaatgaaaggcagatgatgaagtttggacaatggatggaaactatcttatcaagagttggggttataagaatgacagtaggtgatatgaagaaactagtgttttaagaagatatatgtggcagcattatagacatatggggatttagaacaggattatacctactgaactggacttattttatttctagaaattttgtgataataaataccatacattatatgttgttctcatataggagacgtaatatatgggtatgccattaatcaaaggctgattttaagtggaagaattcgttctgttggtttacagtcccagttataaattaatgggcttaccacgtagttgttcccagatcttggaagtattgaagttttttaaaaattaattaatttatttttaactgacaaataatagttgtacatatttaccgagtacaacgtgatgtttttgatctatgtgtatgttgtagaaagagtcagtcgagctgactaacatatctatcacctcaccaacttatcattttttgtagcgagaacattaaaaaatctattcttttagcaattttgaaacctataatacattatttttaactgtggtcactgtgaggtgttgaatgttttaggaaattctcagataatctcagggccaagtgttaagcagatcattctctgagactggatcttctgcagtatgtctgcgaacttttttatttcactctaagcctttgttgttgccttcaggggttactgactcacgtttaactcaaggctgactgagttagatatataccgcctatagttgatgggttttgttgccagaaatattcttttgcttatcagtggggaaggtttttgcttctactgctggatttaaaggtgtccctcaagattccattactcagttcattgagaaaagcttaaagctaacggaggggagttctgagctctgtttgatgaaggaggctgggtaaaataatagctcccaagttggctcaagttcttccagatgttcatgtttatgtaaaacttaacacttagagatattccatgttgtaagatgtctgtgcaaaagttccttatatcaaattctaaaatgatttttggtcatcaggtgcaaaaattaacactaatcatctaaaataaccaaccagatagattttcattctgtttgacttttgaaagcaaatacccctatgatattgagtgagtgttttattgtttgattttccttcaaacttgctgtaaccctatgggaaagatatgcaatcaaaataaaagaacagtatccaaaaataaatgggtcatgaagaattgtgcttaaaatcgttaagtaaacagacacacaccacagtgatgagattgtagaaactggaaaaaatgctgccagctgaagagctgcaaagagtttggcttttcatgaacttagttactgaaatgaaagttcctccctaggagagaagccaaaatcatagcacggtttgaataaaagtacacctttccaaagttactgcagaacaattatggccgggatcctttactcttattgagaaagctcggtaacctcttattttaaattgacttccattgagcaataatgcctccctgcttgcactgtaaggtactttattgggtaatgtgtttacaagctggtctcatttttctttttgtaataggagatgggtagcttactgctatttggaggtgactccaggaaacatgattttcaagatggtcattttaaaaaattgtgattattgggaataataactctagagacaagatttaatggacttacttccaatttattcagtatgtcaccaggttattgcagttctagttttaaatctgtacattcgaagtctacgttgttccctgatgtactgtatatttaggtttgtactactacatataggtgctaggtttagctccaactctcagcaggagcctaacctctcagaacaattattgtagccagatctttggtggccctactacttgctttttttttaaccactactatttctttaaaatcaaagatatggcaaacatattactaaaaggaagaaaacccatcttcaacaacattatggtgtttttcacttcaaaggcttattttgtatgcatcatttgatttaatttcctccaaagccttgggaaatgtgagtgattatcatcttattattgttgttgataaatagtagctactatttatttagcactaactctgtatctggaactgtggtaaacaccttgtagtggaaactaacaatagcctcaggaggctggaattgatattatccccattttacagacaacgaaatgtgatataaataacataacgtgccaagattatgcagctagtacataggagaactggaattcaagccctagttaaattgctttgacttcggagcctgagtgttgattgtctatggcatgttgccaagctattttatagctggaaagcctggtgatgctaaaagtttaaataccttgccctaggtcataaaattagttcccaatgccttccaactgaaatcccaaacattttttattacactttgttgtccgcaggactgctacccgcttatatggtactctttgaaaattaaacaaagaggcatcctccccacttcccaaatccacagaatagccaattttgaaagaaagcacgcttttttttcagtatgactctgctttattggaggatcacagggatggctggggggaatgtgggtatgatactcaagcacctttgtgcaaggtgcaatgcccagagccataaggagtggccccagttgtgctcatttaaaggaatagttggacaattctagataatattaagggagatatccaaaagagtttcctataagtatgtgctcttaagagctgtaaggaagtaaaattttgaccccattagttacatttctaacatgatctaacatcttcccttcactgccaacgaaaatgtttaagaagatataatctgacagcagttatgctaaaactcccctgaagccaaaatgtgtcacttctcaaaatgaccctcatcttcacaagcccttgaagaggagttgaggattatttatgaactaggttttaacctaaggtgatacattgtgctgcagttgttactgagcttagggatcattttgtctattcatttcaggttaccattaggttctttttcaaaatcaattccttttaattatacagctaccctgggcatatattaaatgtcttacaacattgatacgctttcccctgaagtactgacaaagtaatagatttaatgcgcaaccacaggcataaaaacccacacacagtgtaagcatacaatgagtacactgatactcacaaaagaggtttaaaaaaatgtctgtaactggggatgtggtggtgtgagggccccatgaatttttagcttggaggatatcttatcgtaccgatgaaccctgaggatatgcatgaaaacaagctcctactcacaactttttttgcctgaatggtaagtttgtctgcagggcttggtctgattgatttgaaggagcatggtctagaaagtggttctcaaactgttggataacagaatcacctggggggtctacctaaatgtgcaaaggcctaagtcttatcactgctttaatgaatgtaggtctctgggtttataatgagctcgtcagttgattctgatgagcacctaatttgataacaacatgtcaatgggtacagattctcaaacttggctgttcattagaattgcttgagtctcatttctagagactctgatttcattgatatgaagtgcagtttgggcactgggtttttttcttaaagaagttcttcaggggattctaatatcagcaaagttggagaaccacgggtctaggggcctcgctacccgatgtgttgtccaaagaccaccagcagcagcagcagccgcagcagccccagggaacttattggaaatgcagaatctcaggtcccacctaaaattaccgaatcagaacccgtattttaccaagatacccaggtggtttgtatgcccattaactcttgacacacacttgtttagggagtcaggtagagctggattcttaagcacttccggttagttggatgactgaaaaacctctctgagctccaatctcctcacctgtaaaacgagtttaaggaataacattaccaatattgcaggtttgctgagaagattcttgaatgcaatacctgaaactcagtttaattcctagaacagtgaaaagcctcattaaatatgaagtcccggccaggcgctgtggctcacgcctgtaatcccagcactttgggaggccgaggcaggcggatcacctgaggtcgggagtccgagaccagcctgaccaacatggagaaaccccgtctctactaaaaatacaaaattagctgggcgtggtggcgcatggtagtcccagctgctccggaggctgaggcaggagaatcgcttgaacccgggaggcagaggttgcggtgagccgagatcacgccattgcactccaacctgggcaacaagagcaaaactccgtcatatatatatatatttatatatatatatagtccctactagaagagagtccctgtgaacctttttttacactagtggccccagagctaatgaggccaagccccaccaatgatcgtcgtcacagacattcctgtttttctgatatttataaaggttccttttaggtatgaggtgatttttattcaaaagaacaaatgttcccagatgccaagtgtcttccgctaaaaggataaatgatcagaaagcaatccttagctacagtgtccttgaaggtgcattgtggaatcttgcactgttgtgcaattgtgaacaacttcatcagacagtactgcgtatttgtactgtgttatccttaatttttccctttagatcttaatttgttatttatttcttccctggccaagagctaatttctttacagaaactcatatatagggttccttttttcctcctcaagtcagtaacttctgcaattaactacttttttcttaatttctctaactttggcccaactaaatattttcccatcattcctgttttgccgccctcgagctaggacatggaacttacttgttcggaaaagcttctatctgattgaaagggcatgctaattctttctttatagtgtaattgtttcacatttaagagggaaggagaaacgcctaaagtaataccacagaagaaataccctcaactaatctttctaagcagtacgacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaatcagtcacattttaacttactgccagcacggtccatgcttataattgccaaatattttatattaaagaaaacaaggtgtgggtttttttttttgtttgaaaccttgtaaaattgtggcttacgtaaaaatgaaataagtatagaacatggctttttaaaaatatcagtggcaatgataatgacactttatattgtatgcttttggtcgcattaaataaacatatgttgagcacatactgtttgccgggcactggatctactaaaaaaaaaaaaaaaaaaaaaaaaaaaaaaagcaaaccttaactgtaactctggatttcttttacatgaacttcaatcattttaacaacttactctaaagaaaaccaagaactgcagctctacttggttatattgttaatgaagtccttggaaaaatttagtttatatgctttgatcagatggggattgacatacttaagagttttatttttaatctgaaaatccacttcaatcttatgctctgggtaaacagtcattacagaagcctgacacaattctgttttttcaagaagcaggattcaaggtttaacttcaaatacaaatttgagtaagttatacggattattccttttaattctttttttaaaacacagggtttatgtggatgaagtttcgttcttaatctccatttgccttaagaattaacttctgcattgtggtttagattgagtttaagattgtttcagattttaaaatgtatttttaaaggtgtgtctggaggaagatatttgtatgtcaagcactgttggttttcataggaagttcaaatgtgttttcagcagcactggacgtttttagagttattttcttctcctagcatcacacaggtgcgcaactttataggtccagtctcttctttttgcttccttctctgcttctttttctttttcactaacaccagtttgcataaatgagtgcactgtcgagttcacgtgaataccagacaaaaatacaggtgtcttcataataatcagctcctctaagtctactttccagtttctgcttcagactcagataaatcctatataaagcagacgacacagttatttctagaggaactgaggttactgattagaagggaacgtaatcaggtagattgagccggtgagggaagaaaccattgctgtgagaggggagtgtttgcaaaatgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaaggtgactcttttggtcaatttgcaacccctgggatatatttggatgactcctgttccatatgcctttctataaaagttaaattggggcttttgttgtgaggaagggaagaaaggggtttgacaccaataacctataggataatgcaaatcactgaaataagaaggaacccatattctactttttgggttgtggctttaatgaactttgtcttcaggtatctaaaattatttctagtatgaagaaaagaaaaaaatatccagaccttaatctataaacgataatatttttacctcaaattaaatttctaaggacgtagactacattcataaactcattagaaaactaatgagggatttttatattaacaatagaaaaacctgtgtttcacatatatatatgggcttatttatgcatatatgtacatatgaatatgtgtatgtgtatatatatacatacacatatacactcacatttttaagaagtttttaatcaaagaagacggaaataacaaggatccttgtgaatagtaatttagacatgtttagacaagcacaacttattaggaagcaaactgggacaattgtaaacagtaattccaggctgcctaattatctgaaatatctcagaatgattttagaggttaaacacttattattaaatggtagcttctaaataaagtgaaaaggtgtagtgatttatcaggtttttttttaattatagaatatcctaaaattctaaattagcatatattctgttgccaatatatactgtcagtatatttgaagtatattaatttctaaattatgttacttttattaaaattccaaagagtttctgacttggacaagttttctctatctttaggaagacagctagtttttttttcaggggggtgagctaaaagagttaggataaagtacaccgcattaaattaaaaacgtgtgttgggaataaagacaatccaaagttaaaagtctatttggatctcaaattttcccataacttgatttgtaagaaaagttacccttttgcaagtcttctctctcatttggtctggactaagtggttgtcatttctcacttacagattgctgttttactaatctctttataaatatattttttaattttatatctgtattttattcatcagattgtcctggaagtacagaggccagttgatggtttatgagttcaagctgagccgaatatagctaagccctgtcttgcctgacatttcatcaaaagctgtgttgatttgcaatgtttaccgacctatttattgaaccttcacagcttgaactatgccaccaagctcgctgacattgctgagattatctctaaatgcatgtacaaactaaggaggaaattgaaaaataagttaaaaacaatcatccgtctatttattaaattatgcttatagagtccttgatttatgtatttgtttgattgttctccgcaaagccccatgacctgatttttctttgatcttcccacacactcttggaagacgatagattagaacagtggttctcactcttccttgagtgggcatcagattcacctggagggctggttaaaccacagcttgctggatgccacccccagagtttctgattcagtccttctgaagtggggccccaacctctgcatttttaacagattttttaggagatgctgatgctgctagattactaagaacagaaaatgagtgttctaatacaaagagcagaaaataattgttcttaatctagttacctgtgttctctttatgcgttgtttagtttacactgtacaagaaaataaacacatatcctcacaaaattgaagcatatattctactaaagattaatatattaaaatattgaataaaatattaaatatctatgttaggaaattgtattcctgctgaaactggcagtaaaattacttaaattacttagcagtaaaattactgttgacaaaagtaaacaattggtcattaggtctcaaatacgtaaaacctcaattttttttttttttcttgagacggagtctcgctctgtcacccaggctagagtgcaatggcacgatctcgggtcactgcaacctccacctcccatgttcaagtgattctcctgcctcagcctcccaaaaccctcaatttttaattactcctttgattcttattctctgcgatttctccctatgtaaagttttagtctattatatttttagtaaaatgaaagcatgatccatgagataagcacttgaatctatactatacatcaaagtctccccttttgggccattaaaactaagatgttttccaacttaccttaccaaagccacagtttgaaaactgaaactatgaaaaaactggatattttgcttaattataatgcttcgtaaaaaattagaacgtctttaaaaatgttaacaactaaagtcaaacattcaaaaattataacctttgctataaagttatatgttcattcattgtagtcactttcttttagtaaaatgtaagcttttgatgtattctaatggggcgcaacgtttagattaaatgtttaatatggataattgacttttaatgaaatttaatctagatgttcgtaactgagagttaggggtgaacatgcctttaaggatgtagacatttttattacaattattttctccatgtttttgattaaacatatcaaggaaatatatattattttttatttaacttttctaatgtattaatttttggccagtcctacctatcacatgcttcagcaataatcagagctttgatgacaatgtcacattattttaattcagatgttattccagtttgataagatggagctgatctttagaaaacaagtgtaccatatttctaatctttaaatattatattgaattatttcagcctggctcacttgccagtttttcccttttgttttcatgattaaagcaactgataattattaacatagataagatttatgacattaatttatggttttcttcataaaaataaagccttttttttttttttttttttttttttagatggactttcgctcttgttgcccaggctggagtgcaatggcgagatttaggctcaccgcaacctccgcctcttgggttcaagcaattctcctgcctcagcctcccgagtagctgggattacaggcatgcaccaccacaccaagctaattttgtatttttaggagagacggagtttctccatgttggtcaggctggtctcgaactcctgacctcaggtgagccacctgcctctgcctcccaaagtgctgggattacaggcgtgagccaccgcacccagccaataaatccattcttaacggaattttagagcataaatctgagaaaagaaactaaggctgtacgtactaggtctcctatacaccttgtctttcatcattgaatccttagtagttaatacctgcttggaatgtaatgggaattcaataaattaattaaataaatggatgagtgaatcctacagacaattttgccaaggaagaaaataaagacagggtatttttatttctttcggttttttttttttttttttttttttttttttttttcagacagagtctccctctattcgcccaggctggagtgcagtggcacgatctcggctcactgcaacctccgcccttcaggttcaagtgattctcctgcgtcagcctcccgaatagctgggactacaggcgcctgccaccacgcccagctaatgtttgtatttttagtagagccgaggtttcaccatgttggccaggcttgtttctaactcctgacctcgtgattcgcatgccttggcctcccaaagtgctggggttacaggcgtgagccaccgtgcctggccagggtatttttatttttattttatttttttgagacagcgtctccctctgtcgcccaggctgaagtgcaatggcactatctgggctcactgcaacctccgcctcctgggttcaagcaattcttctgcctcagcctcccaagtaactgggatataagcattcgccactacgcccagctaatttttttgtatttttattagagacagggtttcaccatgttggccaagctggtctctaactcctgtcctcaagtgatccgcccacctcggcctcccaaagtgttgggattataggagtgactcacaacgcccagccttttatttcaatttttactgctgtttgttttcttccaaatgaataataaatatgacattttattctgatagctattagattatgaattgaatgtgagaacaaaaggcattctggttttcgtttgttttaatattggactgaaaaaaaaaaaaaaaaactcatttgaaccgggcgtggtggctcatacctgtaatcccagcaatttgggaggctgaggtgtacagatcacttgaggtcaggagtttgagaccagcctggccaacatggcgaaaccctgtctctcctaaaaatacaaaaattagccaggttgtggtggcaggttcctgaaatcccagctactcgggaggctgaggcaggagaattgcttgaacccgggaggcggaggttgcattgaaccgagatcgcacccctgcactccagcctgggcgacagaggtagattctgtctcaaaaaaaaacaaaagaaagtagaacaaaaactcatttgagactttcaggatacaataatttgtttaccttttcagttttctgattcctcatggtgaaggaatcatatctcttcagtgacacacaaacacacacaggatatatacagttatgtgttaacaccagggatacattctgatcaatccatactaaggtaatttcatcgttgtgtgaatgtcacagagtgtacttacactaacctacgtggtatagcgtagtgcagacctaggttgtatggtatatcctatttctgtttggctacaaacctgtacagcatgtgactgtactgaatactgtaggcaactgtagcacaatggtaaatatttcaatgtctaaaacatatctaaccattagaaggtacagtaaaaatcccgtgttataatcaaatgggaccactgcggtatatgcagtttatcattgactgaaacatccttatgcagttcctatcttttcttttgggccacacttggaattgaaatggaagctggagaaaggaagaacatgaaataaactgatgtttttccagccagtcaaaactcagcctctgtgttttagagaaagcattcggaacacagttgagagagggagagaaagagaagtggaaggtttagagggaggtccccgcttgtttttatctcttcaagcagctctaaatttgtccaaagcagaaaaagttgtacttcgcttcactctatattcaagactcaaaccaagattaaacatgaacctgtgggaaagttctttttaattaaactcatgttatttgaaaatacattatggtaagatatttttttgaaagttaagagtcagattttgtctgcataatgaaaagtgactaaggagtgctgaagttatcactcaattatcaggaaatctagaaaaattactttccaataaaaatgagcatcaatgatttctaccacagccttttggttaaagagtaatgaggagaaattctgccatgtaattaaagataatgaaattatcaatcaaggctaagctgcattaggttctttgactaaaataattttatacaattttaagtataaattaagttaaaatatatacattgagtgtgtgcattaatgtagacagtgccaaatattcaacaaaattatttcaccacctttgatttttgttttttgttttttgtttgtttgtttgtttgtttttgagacggagtctcactctgtcacccaggctggagctcactggtgcaatctcggctccctgcaacctccacctccaggctcaagcaattctcctgcctgagcctcctcagtaactgggattacaggcatgcaccaccgtgcctgactaatttttatatttttaggagagacggggtttcaccctgttggccaggctggtctcgaactcctgacctcaagtgatctgcccatctcggcctcccaaagtgttgagattacaggcatgaaccaccatggccggctgatttaagcacctttggaatcataattattaatcataaatgaaaccaaactaaaaataaagtataccacatgtgagaacattccaatgaataaaatcatttctgtgtgagctagcctgctgttcaaatttgtttatgcttatgcttcagataatgtttacaaaagtactgacagattcctagaagcacaatttctaaacacttaccttggaggtttctagggccctaaaaatatttctagtcatttcaaaaaaccacaaaacaactacaaaaaatgtacttctcccaaaggccatacgtagcacatgcaaaaagagattctgcagagcattttggaacgtaagtagcttttgtggttctgtgtctcaaattagcctgttcttaaaagtctgcaaattaaaaaagaatgataggccaggcgtggtggctcacgcctgtaatcccaacattttgagaggccaaggtgggcggattacttgaggtcaggatgtcgagacctgcctggccaacatggtgaaaccccgtctctaccaaaaatacaaaaaaattaaccagacatggtggcatgcgcctgtagtcccagctactagggaggctgaggcaggagaatcacttgaacctgggaggcggaggtttcggtgagccaagatagtgccactgcactccagcctgagagacagaggaagactccgtctcaataaaaaaaaaaaaaagaatgataaattgagtcaaaattataaaaattcaacagacgctggcacagatttgagatttgaggaaccagtaaaaaacgtagtacatattgataaatggcaatgtggtgtcaagatattaaaattggttttaatcttattaaccaacataaaatatggaaaacttatacatttaagtgggcccagaaaaaagtttgcaaatagcattccaaaaatcgatagaataatgtgaatgctttgttttctaatcttcacataatagggttggactagatgatttataagatccagtatatagcccctaataataacccctttaaaaagtctttttttttttttttttttttttttttgagagagtcatgctctgtcacccaggctggagtgcagtggcacgatctcagctcactgcaacctccgcctccctgtttcaagcgattctcctgcctcagcctcccgagtagctgggattataggcacacgccaccacacctggctaatttttgtatttttagtagagacggggtttcgccacgttggccaggctggtcttgaactcctgacctcaggtgatccgcctgcctcggcctcccaaagtgctgggattacaggcgtgagccactgtgcctggcctaaaaagtgtttcaatagaggagagaaataaacaagatcctgaagggataagaagatgtaaaagttgttgctgatgttctgccgcatatttctttccccacccgagttccatgcagtatcttgctttgctataaacaggagtaagccagaaatatgaggggttgtgttaatgtcaccagaagcgacctttaactacgaggggatggaagtacttgaaaaaagcacgcagccatctcatcttctggtgcataattctgaggcatgttcctcacagcttctcagagattcaccagcaggactgagccccagaataatgtgctcattgacacacctttgattgcctccttacctttcctaatctcactttctctttcctctcacttgtactttttgtaatcaattgccagataaactgtgtacctgcacctcaaatccttgcctcagtgtctgtctggggagaatctaaagtaacacagaaggttagcgagaaattgtttcacatgcttaaacaaaacagggcaaaggcacttaagatgttagagggagggagggtgaggaaactcacacgggatgacttcactctgtttagtacctaaaagtgaacaggaggtggatcgaaaggaaacagttagtgaacctgcaaatcaataggaagggttagaagactggttatgggagatggaccagatagcccagtaagtgaagaaaaggctcatggaacagcagagaaaatggacatatatcatccatatattttgtttccatcctagtctaatttacccttagatactacaataatcccccaactcatctttgccacttgtgcttttgtccttttctactcactccatactctacatggcctaaaggttgagcttttaaaaacataaaccaggttgtgtcaatctctgattaaaattcgttactgctctgatgcgtccaatatctttaccaagaaccacacttcatttttcttccttttcttctgcagtcttgctgcatttcagccatactgacctgctgccatttctcaaatgccagtctctgtactgctattgcctcttcctggaatgctctcctcatccatcctctaactgccttgatcgccactgaatatacactaacatgcatattgtcagtcacgcagtagtagcttaatatgtatttgcggaataaactaatgggaaagagtaacagcatggttcagttgatggtggataatagtgatttactgagtcacaaacaacatcatctgatgccttagcaaagaggagtaggtattggagaaagaagacaatacttacaattctttacttccttgagctcattttatatgtgtgtgtgtgtatatatatatataaaacatatatatgacatatatgacatatttttgacatatgtcatgttatatgcctccttctctattatatatacaatgtgttcaaggaagtaaagatgttcaataaagttcaaggaagtaaagtctaaggtgtctttgtatgtagcactgaagtgatcagtcagagtccaggcttggctggatatcgaacagtggatgtgtgaagtagaagtgagtgatgccaattttaaagataatgagcagtttagtaggcaaggatttagtgtcagatatggaggttgtggttggcagtagtagtagttgtactgggaagctcttccacagtggtgaagaagcatgctgagaaaggccaaaaagtcaaagtagcatcttgctgtggataaggagattggcataaatggagtaaaagttgagggtgaaaagtgatgtgagacaaggacaaatagacaagttggcttggctaatgtaatacccatgatgtaagaaaagctatgctgagatagctaggctaattccaagggacttttgaggggagcatatcaggttatcacatgccaaaaatgtttcatttcagagactttagtcttctcattaattttatcgctaatccattcattttcaaaatgtatttcaggatttcacatcaggtcgactttaaatcttttgttcagatgaacgtttcttttcctaggactgagtaagacagtttgtcctatccagtgcttaagagtaaagcaagcttatgttgccactgcaggcaggattattaaataaccaattactattcagactgtgtcacatccctttaaattactcaagcaagagtcttggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagagtcttgaacttgttcagcctgaacacatctgatatcctcagccaagtataggatgtaaattagatagcttctggctttactagtgtggaatcaggcatgctttttccccttaggactccatgactaatgacctgaattgtctacatttcaagactagtcagatctctaatggtgaacctatttcattgtttctgcttctgttttgtcccgtagtatatgagacaaaggatatttttatgtgcaaattgcaacaagttgagatactcctttaaaaatggattttctttccatagttgattagcgtatggtaccagatttcctagaaatgtttttatgataaaagtttcaggttctcgatgatgcaaggaaattacagacgttaggtaatgatttgtaatcaggacacatgagaggagttgtaactttactgcttaccctgtggctttgagaatcattaatcctcaatgggcctcagttttcatatctaaaaatactgctttttaggttcagttacttcaagggtcaaatgagataaaatatatgtgttataacaataaaatgtaataataaatatgaggtaccttttcccccagctttattgaggtataattgacaaatggcgattgggtatattcaaggtgtacaatatgatgatttgatacatatacattctgaaatgattatcacaatcaagttaattaatatatccttcacctcacatagttgccattataattttttatgatgagaacacttaagatctctcttagcaaatttcaagtaacaatagagtactattaactatagtcaacatgctgtacattagatccccagagcttactcatcttataactgagagtttctatccttcgaccagcatttccccatttttttccatccccagttactggctaccactgttccactttgctttgatgagcttaacttctttagataaaatgagttactttttgaaaaacaagtttaattggcaaaattgtatatatgtattgtgtacattatgttaaaaaatatatatatatataatgtggcctggtgaaattgagctataatagtagtgtttttaatgactatgtagccgaaagttccaaggctttcagctgattgactatgtaattcttaaatctagtagagtatcttctgatttgagagcagtatgaatcctggcagaaaactatgctggctatacacttttaagggtttgaactgtgttactttatctatatactctgcataaaatattctctctcctatacaggccagctcatttattcttgcttttctagtctgattccccctttctggaatctttttcctccatcgacttttggttctaaagcattcccatcttcaaaaattcaattcaagtcctagttaccacaacactttctctaacggcttgaaacacctcttttttctatgaacttttgttccacatagttatttctacccagttatcgacataattgcttgctaattatttcctgtggattaactttgattccataactttttaacttttttatagatttcctgagagcacgtgctgtgctttatatttctttgtaaatacctcagtagctctgcattttttttctctgtcatccaggatggagtgcagtggtcgatcatggctgactgaacccttgacctcctgagttcaagtgatcctcccacctcagcctcccgagtagctgggactaccagcgctccaccacacccagctaattttcgtactttttgtagagatggggttttgccttatcactcaggctgatctcaaactcccgagctcaggtgacccacctgcctcagcttcccaaagtgctgggattacaggtgtgagccactgtgcccggccagccctgtggttttttgtcgttgttttggtttttttgagactgggtttcactctgtctcgcaggctgcagtgcagtggcaccatctcggctcactgcaacctctgcctcctgggttcaagcgatttttctgcctcagcctcccgaatagcagggattactggtgcacgccaccatgcctggccaatttttgtatttttagtagagatgggtttcaccatgtgggccaggctggtctcgaactgctgacctcaggtgatcctctgtcctcggcctcccaaagtgctgggattacaggcatgagccgccgtgctcacccagctctgcatttttgaatcattgtttataaaacattgagcatcaaataatatgtttttaaatattgtataagtaatactgtgttcatagaaacgttttcttttggccgggcgcagtggctcacgcctgtaatcccagcactttgggaggccggcggatcacgaggtcaggagatcgagaccatcctggctaacacagtgatacaaaccccgtatctactaaaaatacaaaaaattagccgggcgtggttgcgggcgcctgtagtcccagctactcaggaggctgaggcaggagaatggcgtgaacccaggaggcggagcttgcagtgagccgagaccacgccactgagctccagcctgggccacagagcgagactccatctcgaaaaaaaaaaaaagaaatgttgtcttttacaaccatatatttatcatatttatcagtagtttaggcgtggtcttgaaaaggaacctccccctaccataatgcctttcgtttaggagatccccccattacacttgtggcttacattgaaagaaaaaaaaaattatccccttgtctatggtagaaaactgtgtcattcgtggctttgactgcatcacaatccattttagctttttgtcacttaacttgagaagaaatgaaatatatgtggagtgtatatccctgaagaaagtaaaggaccagctgttatcactatagagtttgtattgttgctgaaaataatctggttatgtttgtaaggattaagtagtttattcaacagatgtttggtagtaaacatgaatgagaaaaggcttgttcttatcatattcattatgaatgctgaggttgtgctttactacatgttttcaatgctcatcctaactgaaagtatgaagtggaaggatcaatttctgaatatttaaatgagatgttgattgccttgttataaacattaacaattttcctaagtgtttgctcttgagatagagcatctttaggagaactttatgatttgggctggcagatttagccaaattaacaggaatgtaccttcctaatgtgatcattcatccctaggaacaggaatctgggaacactgaggctatacttctgtatggtgagttatcaaagtgttaaacacaggcactattaatgaagcacagattctactttcagagtaaagctagtgttactatctatgaaaaaatattattatttatgttttcataataataacttctacattatatttattttcaactttttagaataaatctgagctaggaggttcttattttagttgttttccttctatcgtttttcattacgctcttgttgtttgatttggtctcacattttaaaaagcttactgtataagaaagttttatcttcaaaataatgagcactagaggttactataaatggaaatacaaaatgtggatttactaaagtgttttgacttttacctacacatttcttggagtaatttttaagttgaattttaagaattattttgctggccgggcacggtggtggctcacacctgtaatatcagcactttgggagtctgaggcaggcggatcacctgaggtcaggagttcgagaccagcctggccaacatggtgaaaccccgtctctactaaaaatacaaaatttagccaggcgtggtggtgggcatctgtaatctcagctactcgggaggctgagacaggagaatcgcttgaacccgggaggtggaggctgcagtaagccaagaacatgccactgcactccagcctgggcaaaaaagtgagattctgtctcaaaaaaaaaaaaaaataataataatattgccatatattcgaattacacaataataccagattgaggatattagaggaaaacaaatattatattttcaatatttctaaagtattttttgtcttggttatttttatggaattatattacatttatagtataacctaactcttaaccattttgaggggtaagtttaaagattaacttatcactattgacgaattattcatctacccgtggaagtgtctgcagtttatccatttcgaaacatctaatattacatgagaatttacttttctcattagattacataaacatcatgttaaaatgcaatatgtacatgtgacaactgatcttttgggaaaaaaaaagtccatgaatcactcctgtaacatttggaattaaattcattaaccaaaataatatcatgcttcatcttttatattttgcttccttagcatctggttcttagtctgtctaattacattataatggctctgtgttacaacagttgctagaagatttttttgggggggggggcaagaatgatgattttgcctcatattttggaatacctgctttgcaaatgtctttcctatatactagagccagaaggaaacaaatctaatgtttcttattcgtttgaaatttattgggagaccaacttcattcaaagatcaagaactctaaaatttttacatcaaaaactatttttttccccaattactttgttgagtactgcacttccagtcttgagatcgaaagtaatgttgaggccgggcacggtggctcatgcctgtaatcccagcactttgggcggctgaggcgtgcggatcacctgaggtcaggagtttgagaccagcctggccaacatggtgaaaccccgtctctactaaaaatacaaagaaaattagccaggcatggtggcgggcgcctgttattccagctactagggaggctgaggcaggagaatctcttgaacttgggaggcagaggtcgcagtgagccgagattgagccgctgcactccagcctgggcgacaagagcaaaattccatctcaaaaaaaaaaaaaaaagtaatgtttagccttgaaattgctaatacaatggacggtatccagcatatttcttttttgtatgcaattaatatttttactttatttattttatttatttttttgagatggagtctcactgttgcccaaactggagtgcaatggcgcagtcttggctcactgcaacctctgcctcccaggttcaagtgattctcctgtgtcagcctcccaaagtgctgggattacaggcacgagccaccgcgcctggccgatattcttactttaacagttgaataagttaatattttattggagctatgcaattagttaatttcatatagtgaatatattaatatcttatgaggaagagccacaattttagtataataatgtagataattataactcaggaggactatgatcaagatacactgtaaggatccttcaccatattttaccaaaatattattttatagttcaaagggggataggacggtacacttccaattatgctgcaaatttgttattattactgaaaaagtctattttcttcttcaagcaattaactattaatgtctttaatgtcaataaaccgcatagcgttatagactctctttgaatttctctgaattagaaataatttttgaataggaagattaacacagactcattttaattctgtaatggtagaaataattaatctccccttatctgtagggatacgtgttctaagacccctggtggatgcctgaaactgtggataataccaaaccttatgtatatattatgtttcttatatacatacacatataacaaagtttaatatatacattaggaaccataagagattaacaacaataactaatattagaacaattataacaatatactgtgataaaagttatgtgaatgtggtctctatctctcaaaatatcttattgtactgtactcatctatttttggactgcagttgatcatgggtaaccaaaaccatggataagaggcagactactgtgtattttattatatgcatgttatatataatatatgtaatatatattatttgtatccatttggcaaacaattgagatttttatttcatgtagttgctttttgtactaatatagttatatggttgttggaattatgtcattaaaacacattaagccaagcatgctggctcacgcctgtaatcccagcactttgggaggccgaggcaggtgaatcacttgaggtcaggagtttgagaccagcctggccaacatggtgaaaccccggtctctactaaaaatagaaaaaaaatcagccgggcgtggtggcaggcacctgtaatcccagttacttgggaggctgagtcaggagaatcccttgaaccccagaggcagaggttgcagtgagccaacactatgccatcgcactcgaatcgagcctgggcaacaagaatgaaacttcgtctcaaaaaagaaaaacacacacgcacattaagagaaattatgtttgtcgttttgtttattctctaatttgattaaattgaacagaataataagtcacgtatggcaataccaaatattatgctaaaaataaaacactgaaagctgaaaaattcaatcacagattattggtttatatgacatcaggcttcaggctgataggagacgtccaaatgataggcttattttgttccataagtattgggcacggttcttagtataacaaagaaataaccgtggattgagaaattgttttcctcaccttcattacttaatagtagaattcccttcaatgtgccacttaatattccttgatgtcagagccttccatttgagcagctgaaattattgacacccctctcattcttcaaggatgtgttgtagggactgctgagtttctgtagaggtttaagctttgtgggaaatgatgttgagtatgacaatgttatcagcaacattgtcaacttcatggttgcctattgacttagggaaaagtggagaaaaatatgacaattgctgagtgcttagttgcagtagctttttaattttaattttcaagcatctgtgtataagcaaaagaatatacacagtgccacgtatcatacccattgacaagtttatcagattttaattataataaatattttaattaaaatgttttttaaaattattaattttaatgaacatcaaatttctctcttgtgatgtgataagggcagtgatagaactgacatttgaacgttcaatacacaattcggccaccattcaataggcttggattgtgcccatggttctgttctgtactaaagacacaaagatgaacaaataaaaactctgcccttgaagccatacagtcaaaatacagtgtccttaatctggggtccatgaaccatgataggaaaaaaattacatctttattttcactaacctgtaactgaaaatttgcatttctttccctttatgaagataagcaacacagaacggtattagcaatatctgtgaatttattaccaatatttttatatcaaatcctagttgttttggatatcttgaaaaatcatatgttaatatataccagtggttagtatactaatcactacttttaatttgtattaattattatgcttataactaatgtattaatagcatataatagtattatattcagtattttacaattgcaatataattaatttcctttgttttttatatgcttttagttttcattttgcacatttgaaaacagtctgggaagtgttccatatgcttcaccagatgccaaagggatccatagcacaaaaatagttaaggaccccatatctagaagagacacaggcaagtacatataataccatggtacagaaaaataacagaggcttgtaccatatgctgtgaaattgggcataactctctcagtccaaaggactgaagaggaaatttttgatttggccttgaagcacacgtgattgtttctctagtggtaacatgtgagagagggcattctaaaaaagagaaaagtaggtgcaaagtcgaagtcacccggtgagagcttgcagggtcagggaacaaagagcagtgtactgtggcaatgtaaacaaacaaagaaacaaacaaaaaaaccttttttttttttaaaccattgttgggcatcctattctgttttcatttgtcaatgtgcaagattgcatttgccaagcagtttttattaatcattagtgagtagaaactattctctggctttttattttaactgactatatttcatatagacaacaggcaagaaacatcaaagaagagatcaaagctctgcattagcgttttaaatctcattatttcaaacaacatctacctgtaaggggaaaaaaaaccgtaaatctttttcacctccccacttcgtcgttgttttcagacaacgatcagtcacttgtctggcctgtgggccataattggctacctgtaaatctcaagagactgaaccatgtaactggaataattttttttttttagcactacactacacggctgttattcagttataatggtcaaggaagctttagatgctgtacttaggctttctaaatgtgtgctttatttggctttctgggagaaatgtcaatgtgaatttccagattataatgaagttcatccagaaaaacaactatgatttaaagaagcagaagaaacaaaccggactgaaaaaatacactaatagactaagatagtgttttcaaactgttctagattaagacaattttgcttgcattctttgttgagcaagaaggttcacatcttaacttttccaataatcctctttaagaccgttattattggccttgatttcaaacagaaaccagcagggacctgaatggacactactagttaaccagtctaaagccttatgttaaagctaaacagttatctctaattttcaaaacaatagcatgagtatatattaaaaagtggttgatctagggaacttaatattccaggatgaactatactaaatgaaaatatgtaacacattaaaatgtggtcaaacaagccatctatagctgatagtacaaattgcatatatatctactttattaaaattttaactggccaataaaattgatactataattctaaatataatttttatttaagattacaagttttaaaattgaacagacttaggtttaaatcacttctctctcttcttctttttttttttttttccgaaacggagtttcactcttgttgcccaggctggagtgcaacggcgcgatctcggctcactgcaacctccacctcccaggttcaagcaattctcctgcctcagcctcatgagtagttggccctccaccatgcctggataattttttgtatttgtagtagagacgaggtttcaccatgttggccaggctggtctcaaactcctgacctcaggtaatccgccctcctgggcctcacaaagggctgggattacaggggtgagccaccgcggccagccaaaatcacttcttaaatgtgttattctgggcccagcacggtggatcatgcctgtaatcccagcactttggcaggctgaggcggtccgatcacctgagatcaggagtttgagccagcctggccaacatagtgaaaccccgtctgtactaaaaatacaaaaattagccggcctggtggcacatgcctttaatcccagctactcgggggtgctgaggcaaaagaatcccttgaaaccgagaggcagaggttacagtgagccaagatcatgccactgcactacagcctaggtgacaggtgacagagggatacttcgtctcaaaaaacagaagacaaacaacagcaacagaaaatgtattattttgtattagcttagctcagcatgtttgcttgtatgtaaagtagaactgaaaaaaaaacctaataaaattaaaatagggattaaatgcactaaaatttgttatttgttctacgtatttcaaaaatggtagtcattctaattatttattttagttaatggaaacattagttttattgttagtaaaacaatatattgttgatacaatatctagcataattttgcctcttaatgaatcaatcagcttgtcctttttattcatattttccttaattataaaccaattttttaaaagtcataatctatcagtagaaatggtactttattaaattcggagaatagtatcatttaaggaaaaatattcctagataaaaaaatatacagtactatgaaattcacatgcatttaaagtcattattaatttataaagaatctggaattataacctgaactaaataattctatttttttgctgaatgaatgaataaataaatgaatctttaggaacttgactgtcctccactaaagttaatgactccttcaacatattacacattctgttgctttgttctcatttctattataaatgcaagtttgcttttttgcatatggaatcaccatctataaattcatagtcaatatggggttttaaataatcattaccatggaaattatacttaagtattagttctgttggttggagattatgaatttctaaatttaaaaaaatgctgatttaaatttattatttccagtgccctatcctatttttttttcatatctgctactgccttcctaataaacttgtttagaaatatatcttgacagcaaatggtattttattcctaccctcttggcatgtattatacacaaactttgttttttgttgttgttgctgttttttttgtgtgtgttgggggggggggggggacagagcttcgctcttgttgccgaggctggagtgcaatgatgccatctcggctcactgcaacctccgcctcctgagttaaagagattcttctgcctcagcctcccgagtagctgggattacaggcatccgccaccacagccagctaatttttgtatttttagtagagacggggtttcaccatgttggccaggctggtcttgaactcctgacctcaggtgatccgcccacctctgcctccgaaagtgctgggattacaggcgttgagtcactgcacccggccttaaacttcttttcgaaagctttctcttttatacgtattgagttaattcctgtttgcgctgtgacatctacctgactaccacaaaaccttacagccacttgcttctgtaaatggaaaactgccctagcatgacaggatgtgggctgaagacataaccatatcgaaaacagcaagctttttggaaatctgtgtttggccctcaatttcatggcctcaagtaacttgataattttctatttctaatgcctgtcagccacaacaggatctgataaccaactaaaatctctgttggaagtgaataggggaaaataggtgaaatcacatttgatgttgtaagggaagcttattgaagacagtggatgtgttcaaaacattatgaggcaaataatgaggaggaaaaaatatgaggaaatagatcaccaggaagccctgtgaatgtttatgttttggctttacatgattactagtaattaaattagtgaaaaatattttatggaatattcaatatgcccttaatgtacaatttgctgagcaataagaatataagactacaaacttcctcttattggaatatacattttattttttattttgttgtacttcaatagctttagggtttcaagtggtttttgcttacgtgtatgaattgtataatggtgaagtccgggattttattgagccgtcacccgagtagtgtacgttgtacccaatatgtagttttttatccctcattcccaccccctccacttctgagtctctgaagtcccttatatcactctgtatgcctttgcatactcataagttagttcccattataagtgagaacacacagtatttgattttccatttctgagttacttcacttagaataataacctccagttccatccaagttgctgcagaagacgttatttcattgtttatatggctgagtagtattctatggtgtgtgtgtgtgtgtgtgtgtgtgtgtggtgtgtgtatctcacattttctttatccactctaaggtggattctatatctttgcgattgtgaattgtgctgcaataaacatatgtatgcaggtgcctttttcatatagtgacttatttttattttggtagatatgcagtattaggattcgtggattgaatggtatacctacttctagttctttgagaaatctccatactgttttccagagaggtattaatttacacttccaccagcagtatataagtgttctctttttatcttgtccatgccaacgtttattgttttttgactttttaataatggccattctggctaagataaggaagtatctcattgtggttttaatttgcattcccctgatgattagtgatgttaagtattttttcatgtatttgttgatcatttgtatatcttcttttgagaaatgtatattcttgtcgtttccaagctttttaaagagattgttttcttcttgctgatttgcttgagttctttgtaggttgtagatattggtcagttgtcagatgcagtttgcaaatatttttttccattctgtcggttttctgtttacgttgatggttatttcttttgctgtgcagaagctttttagtttacttagatcccatttgtttatttttatttttgttgcatttgcttttgaggtcttggtcataaattctttacctaggccaatgtccaggagagtttttcctaggttttctttgaggagttttatggtttcaggtcttagacttaagtctttaatcctccttgagctaatttttgtatatggtaggagatagggatccagtttcattcttccacatgtggttgtcccattttcccagcaccatttattgaataggctgtcctttgcccaatttatgtttttgtatgctttgttgaaggtaaattggttttaagtatttggcttcacttctggcttctctattctattccaatggtctatgtaggaatagacgttttaaaatgttgcaattggaactatggataaacctttaagataataatttttagccactgttcattttaactgggggagaatgggaaaaaagtttaatcactttaactaaatcagttactttgtttacatatatttagctctgataattacaaggagattcacttttgagtttgaaaagtagattctaatgcctaatgagagttttcacattgtctttgagaataaacactattttaggttattactgatatttcagtttgtgaactaataattcagcttgtgaattttacccaattttataaattcacttttcttacttgggcgtctgtgtttgaattaagaatggttaaatgtttctttcatacgcgtccgtgtgaagagaccaccaaacaggctttgtgtgagccataaagctgtttatttcacctgggtgcaggtgggctgagtccgaaaagagagtcagcgaagggagataggggtggggccgttttataggatttgggtagataaaggaaaaaggggggttgttctctggcaggcaggagtgggggtcacaaggtactcagtgggggagcttttgagccaggatgagccaggagaaggaatttcacaagacaatgtcatcagttaaggcaggaacaggccattttcacttcttttgtggtggaatgtcatcagttaaggcaggaaccggcaatctggatgtgtacgtgcagatcacaggggatatgatggcttagcttgggctcagaggcctgacagtttctacatgatagtctctttattcaaaagaaacacactacattattattttaaaacgttattaacatatttttctgtgctagaaaattttaagaaacaaacatttaagtgggctaactcatttagaatttgtaaaatatgacaaaactctaggagaaagtttacctgtgaaaggagtctgttatgtaaatcaatagtgtaattatgattcaataaattatataaattcctaatgagcactatcaatttttcttttgctaaaatctactgatattctacttttaaattactctcacttttagtgttcccctgaggacttatcagtttggaacacttaaatttgagttatcgttctgttcttaggaaaaatatatttaaagaaataatgatttattatgctagatttatcattatttttatttgggattgcttttaatgtgcatgagttacaaagacataactgtgagatcccattttctataatttttttagtgattccatacatttctgagtttacattttttaaaaattatagctcaaaaaatgcaagacataagtaagtatgcttttctaatgggtcatttcagtcgcgtccgtgtgaagagaccaccaaacaggctttgtgtgagcaataaagctttttaatcacctgggtgcaggcgggctgagtccgaaaagagagtcagggaagggagataggggtggggccgttttataagctttcggtaggtaaaggaaaattacaaagaggggttgttctctggtgggcaggagtgggggtcacaaggtgctcagtgggggagctttttgagccaggatgagccaggagaaggaatttcacaaggtaatgtcatcagttaaggcaggaacaggccatttccacttcttttgtggtggaatgtcatcagttaaggcaggaacaggccattttcacttcttttgtgattcttcagttacttcaggccatctgggcgtatacatgcaggtcacaggggatatgatggcttagcttgggctcagaggcctgacaggtcagttatggaaacacatcaaagtactctagaaccaaaagttaatttttgaaagaaattaacttaatgtacagattttataggaattctggacgtatttaatatcgtgatgctagaagaatgtcttaccaattaatattactggatttcttgttgtgtatcaagttgtaacagataccttaatcacctaccagataggctcattcctgtgtccattccaatagaactctgattttgctcagatctccatcctcacaatttcacagtagtcttcagtaaagaaatgagactaccccttgtcacagaaaatgaatcatactttaattcgcttatatgcttccataccacttgccatttacgggtttaagtatgtgcatgagatgcaacctgaaccaattaaacatcaagtaagtttttcttgccaatgaaaagcgttcacttaacaactaaatgcttgagcatttatatgtagatatatatgtacatatatacgatgtaaaatgtagaatgcccactgattcatttataatttgatatgtattagtatgtatttaataagctcttataagactgaatggactctggatatgaaataatataccaagtatggtaacacatggtaacacatggacaaattgtagtggaatcaataaagcattcagagaaatacatcattattatttattctcccactttaggaagatttcaatcctagcattaaatgtaacactgtcttttttaaaataaaacctccatttctaagaagttatttgatgagaaaatatttgagaggttatctgatgagaaaatttgaagaaaaaaattttaactgtacaaccagttaattagaactttgtcaaataacattgcctttaattcccagaaatccaatacattatgctcagtgaactgtaacacctgagtttttaaagtggaatacttaaaaaaaaaaaaaaacaaaaaaaaccagccttctggggtaatatctcctctttggaagtttctttttttccaaaattatacttaaaggacgattcttttaatgaataaattttagagttatctcaaggaataaatagaggaaatattattttatttcaaagagaagaatgtctattgtggcaaacaacaaacctgaaataaataaaacgtgacagtctatgaagtccgtgagcctaaagaacaatggttattttactgtcttagaaaagtttaggaagtttggatttgaattcaaactttaatttgaacttataacgtcaacttgaaatcatttggaataaacattgaaaaccttctttgaaagttttatcaaaggagaaagaatttgaataccaagaggatggaaaggttaacttctgttatctgaaatatcttcaattgccttgagccagtttaaaaataaacaagcttactgatatagagggaaacaagtctaccttgtgaatataatttaaaaaagagaaaaaatgtcatttaccatattatttacttcctcattttagaaaagggaataaacatttattaattatgcactatcaggcactacgcattcaacacacactatcacattagttcttcccaaaagccatttgaagtagtttttctttctttttttttcttcttttcttttctttttttgagagatggagtcttgctctgttgcccaggctggagtgcagtggcacgatctctgcccgctgcaacctccgcctccctggttcaagcgattctcctgccttagcttcccaagtagctgggactacaggcatgtgccaccacgcccagctaatttctgtattttttagtagagacggggtttcactatacgttggccaggctggtctcgaactcctgacctcaggtgatccgcgtgcctcggcctcccaaagtgctgagattatgggcgtgagccaccgcacctggcctgaagtagtttctcttatgcccattcatcaatatagataatagggttcagagagatttttcagtaatttacacaagattttacagctcctaggtggcagaatctagacttaaatttagatctgatccaaaaactgtattttcctagctttagtaggacattaacaatacaagtgcctctttaatatgcttaggaatgcatttttatttatatgtaaaaccaaataaacaaataaacgctgcgattgccaacaaagtatctttaatgtaagaatttcaaatgctgtgcaaaattatcctcactaactgctcttctggtcccacacttgtcacatggctacagaatatactatatctctctttctcttccagcagcttcctagtggccacacagggaccatcctatccataggttatagttgctttttaaaatctaggcatttcctaggagctgatgagattttagaagaggtgatattaacatgaaaaaattggtaggggtagatttctgagatattctatccaaattcaggagttttacaattataatttagttaaatattgtacttgatacacatataattccattaatacactctgagttaattgattttcatttattactcatggttttcattttttgttttttgttttttgagacggagttttgctcttgtcacccaggctagagggcaactgtgcaatcttggctcactgcaatctccgcctcctgggttcaagcgattctcctgcctcagcttcccgagtatctgggatgacaggcatgcgccaccatccctgactaattttatattagtagtacagatggggtttcgccattttggtcaggctggtctcgaactcctggcctcaggtgatccacctgcctctgcctcccaaagtgctgggattacaagcgtgagccaccgtgcccggcttcatcgtttccatctttaacaaagaaatacatgatatttaaagaaattttaaaagtataattttaaaacagagggaaagccacccacagctaaaacatcctttctctaaacagtttattttttccttaataaagttagatattttttggtgtctaactttgcattgtaaaacttaatcattacttacattgctccataatattctgtcatatggttttgctgtagaactgatactgagttggtgtgccccttgtaagaatagtccagtcattttaaaccagcatctgtttggattgggccagcatctcttccagtgtccttgagtcaacaatgccttaatggtttctacatatatttttaaatattacctatagatagttcattctttatcttcttatgttgcgtgtcagagctattacgttagagctattatgtaattttggcttttttatatatcattgcaattaacactcttgtccattaatctgtttgggttttttttgttctctagttgacatcttatgacaaatcaataggtgtgtaaactatgtcgatttttcttggctgtaaaaaacagtaaagaatgcttacagtacacgttgtctttatgaaaggaagttccatttgaagaaataattaaaaaacaatctgttttgcctttaatgggcaagatgaagagttaatgccactatatactaaatatcttaatctcgacatgaaatgagaactattctagagatatgtttctagatagatatggaacaaccacaagttcatacaaaatttgttaattttaagtcatattttggacttttattaactcatatggagtgacgaacaaatccttaattaatagcagacatatcatcatctctggatgcttatctatcagagatcagcaagaaaacaaacacacggcatgctaaaatgggtaaactatgagaggcaataagaaacaatattcaaagttgtgggtagggttaagggaaactaatgaatactgtgatgcaggtggcccctggctctggggacaatagaaagacataacccaccactaggcctaaaaaaggtaaaatgtgagggagcaattactagatcctggaaatggaggagctgaggagagaccgcccaacaagagctgtgacctttgaaaaagaaatacagccacttacaacctgagctcttgcaggtgtaaaaagtagaggtttctctccaaagaaactttcctacccatctaaatgggaataaatagtaacgtctcctagaagcaaaatttattaaacgacctgtgctaacattcttaaatatctactagccgtaataaagaaatcaatgtactttatgttcttagttcccacaatttagcctaaatatttgccctggcatgcttatactggtccaagcacgcattaggtcatagcctgttcctcttccttatttgaaggtgtttttacctttctcagcaagtaacttgtggaaacaagttacttcctccttcctttgttctcctctgcctttgtctcttttgaaaagttctaagttgctagccaatcgggacaaatacagaatgtgtggtcctgttccagccaatggaaaccggacacagcagtagagtaaacatgtcaggttataaatgaccctgtctcctttgttcggtgtactctcgtggcaaaactgctggcgagtgtaccctttctgcaaaaagtaaaaatgaccttgctgagagagttaaatttatgttcgagtgctgtttctttgcagcaccagggaacaagcattctgtttctaaataaacattgtttacatataacacagggaaggagcagtaaagaggatacagcctccacacacctttgaaaagcactcaagttataagtctttagtgccgtgctacttaagagaagggcttgggtttgccctaggttatggttatgctaagctcctcacaatttttataccacatccaatgacagcagacccattcaagcagaattggtttacaccatgagaaactataattcaaagaaagttagcaacttgctcctaggcatacccatattaaccaatattattcagtatatttatatacagcgcagagaacaacaattttaatggcattgtcagtattctttgatagataagcaccagttttgtgatatttaaaaagctattataggtgttgaggcttcgttttctcttccgctaaactgggatgaatctttctgaacagaacaaatacatatattctgtcctatctgggaaagattcaattatgtgttgcagtccaaatatgctgtattatatttacaggtaaaatcatactagcagaccagagtaaataactaggtaagttcctcttagtgacaataaaaagttatattgctcagatagtgctaatagaactttctgcaatagaaatgttctgtatctatcatgaccaatatagtagccaatagccatatgtgactattgagcccttaaaatgttactggtggggctgggcatggtggctcacacctgtaatcccagcactttgggaggctgaggggatgaattacctgaggtcaggagtttgagaccagcctggccagcatgatgaaaccccgtctctactaaaaatacaaaaattagccgggcgtggtggccagtgcctgtaatctcagctgcttgggaggctgaggcaggagaattgcttgagcctgggaggcagaggttgcagtgagcccagatcacaccactgccctccaggctgggcgacagagtgagtgagactctgtctcaaaaaaaaaaaaaaaaaaaaaagagtctcatgtataaatactgttttggacacacatcgttagaagacagtaaaggtgacactgtaaaaattttaaatcattaataactaattaccaccccaatgtaaatttcactgatcactgtcagtattaattctacagtaacatctgtatcaacaaatttccatatccctttcactggtattagggaggagatatcaaaagatggtaaacccagagcataaacttgtagatgtttggtaatgaaatgggactggacctatttgagattgtttcacaattttaaatcagggattggttatatagagctttctttcttgtattttttttctgcttctatgtggaaccatctagaatgcttgtgttattgctttaaggaaagtttttaaagggattcttaaaaaatacagtattttcctagcatatctctgaggtgataaaagtctaagaatcatagtttatgtgttttattcagatccagctcattctctcaactgttaaataagattcttgagaacaggtattattttttacattctggaggatccttatagcacatagaactatactgagaccaaactcgataatttcttataattttgattctgctggtaaaacacaaacttgatattgaaaatttgaatattctggacattataatttgcttatgaatcattctgtttgatattcccagataccctttgctaaggcagctcagaagggaaatatttgttcttgcagtttgtgtggttacgtggtttgttgtaaactttccctttgacctaaagaaatattgtccctttggccaggtgcggtggctcgcgcctataatcccagcactttgggaggctgaggcgagtaaatcgcttgaggccaggagttcgagaccagcctggcccacatggtgaaaccccatctctactaaaaatacaaacgattagccaggtgtggtggtgcatgcttgtaatcccagctacttgggaggctgaggcaggagaatctttgaatctgggaggcagaggttgcagtgagccaagatggtgccattgcactccagcctgggtgacaagagcaaaactctgtctcaaaaaaataaaaaaaaaaaaagtcgtctccaaaatatagcatggcttcaaacagatcgcattatctctctgaaacattttaacttatagatttaaaaatatatcttacagaaacattatttagaaacacaactttagtttacctacctctataaaatctccagagccagagtaaagattaaaatatgcattcacaaagagctttttaaatcatctctttattttacatctcccaaaaattctggaagaaggccgggcgcggtggctcacgccagtaatcccagcactttgggaggccaaggtgggtggatcacgaggtcaggagatcgagaccatcctggctaacatggtgaaaccccgtctctactaaaaatacaaaaagttagccgggcgtggtggcaggcgcctgtagacccagctactctggaggctgaggcaggagaatggcgtgagcccaagaggcggaggttgcagtgagccgagatcgcaccactgcactccagcctgggtgacagagcgagactccatctcaaaaaaaaaaaaaaaaaaaaaaaaaaaattctggaagaagtagtgtttgatttagcactcttaagggacaccatacatttgatgttgttaaaatagcttacaggtttatattagatttctattatctatcctgtcttcatttttggatatcatgtaaatatgttagataaataaattgagattgatttctaacaatttgtatgcattttgagatggcttagaaaacattcaatgcagaagttgatactgtgactcataccaagcatgctcctttgaatataagaagacaaaacttctgaaatgaggcaaatttaaaatatgacaggtttatattctggaggtagtgctaatagcccccaaagctactgatacatgagtttgtacactacagaaaagagaattaaaaagaaagtttgcacttcattgcagttccactcttgattattaatataaatcgaatgtaaattagtgaacttcctgtaaacacaacatgagcaatgactaatattgatagtctactcttaggttcccttgaaattgttctgcttgtctgataaaaccataacaagggacataaaaagattgttttaatatgttgagtgaattgtacatgaaaaattacattcccataaaaggctgatctatgaatgctaacatttatgttgttcgctatttctgtgtacttataccacccgtgtgagtgttgcttgatttggcagaagtaatggaattttaaaaagcagttgcatgagcaaatatatctattttccatatgtacatatttgcaatttagcaagtcatttgcttttgtttaaatattcaaaacgttgtcatatgtgtgttgtacacattaagattttatgtattttaaaaattatatatgtgtattgatatatttgtatgcacacagagcaaagcttgaaatagcaaaaggtaattacatgcatattgtatatactactttgtattaaaaatgtagtttattgatctttaaaaccaaatttgtttttgtaataaagagtaataaaaaattagattatgattttttcctttcaaatatgtttagaatttaaaaatcttggctacccctttaacctaaaatctgtcttacttacctcaaaatgcccttgatcccaactacatgaaatttcttgctctttcttttttttctttttttttttttttgagatggagtcttgctctgtcgccctgcctggagtgcaatggcacaatctcagctcactgcaacttccacctcccaggttcaagcgattctccctcctcagcctcccgagtagctgggattactggtgactgccacgatgcccagctaattttttgtatttttaggagagatggggtttcatcatgttggccaggctggtcttgaactcctgacctcaggtgatccacctgccatggactcccaaagtgctgggattacaggcgtgagccaccgcgcccggccttcttgctctttcttaaatatattatgtaattttatatagcacatgcatatttctgtgtctgggacacccttcctccctgtatctactccttgctatttcttctagcctaatttagatccctctttctatgtttctctggctcttttttcttaagatttgtcaagtcatgctgaaactattgccttgtctttctcaaaagactgtaagttcattgatggcagaacttaagtgtatattagtatctcccagaactcactcagggcctggcatagagtagcataaaagtcagtgttgttgaatgaatgaagaaatgaatagaatgataactgctttctacaggtgattgtgtgtaaacaaaaagtcatatgattaatccttctatgagcaaaagttggctaagattacaattaaatctgaatgtgaagattgtactgcagaaaaaaaaaacacacattttcaatagttatgtcacaaaagcaacccatcatgatacaagtagaatctgcgaacatttcttttaaggtgcgtataaactcatggcaaatttatgttgcattagtctttttgatgttctgaactttcataaaaaatcaacatagtatttaaaatctattgtaaaatatattgaagtttcattgattttattaaaatattaattcctttattttatatctatatataatataatcaaatctgaaaactcatcaagattatggcctagttgattacgtcttagttattatttgtacttttccatagccaacatgcaataaaagtttggttctagataattttttcctgttttacaccgtttcaatcaaaacatgttacaattgagtaaaacaatctgaaccagccttttataatacatgaattccaagattgtactaatttgtcagtttttgcttactgtctttcacaatgatttggagacataataaaatgtgcaaccaaattagtgaaaataaagaagtatatatataattgactagagccaaatatgtatgcagatttaaggcctgatgttttagttcactcattcaaattttaattaaaaacagtacataaaaggtgctagttgctggagtatgatgagaaaacaaaacagtaacaagacaaaaactgaaaacatgtttcctatccttgtgaaacttactgtcaatggggaagacgtacactcagtcagagaaatgttaatatttacaacgtaaagtaatatttacattatctgtattcagaaagagaatatcaaggaagcctattctgttggagtaaagagcttatgcaaagctcctattgtgggaaggaacagaaaggccagggtaactatatctaagaagaaaattacaggctgggcacagtggctcacgcctgtaatcccaacactttgggaggccgaggcgggtggatcacctgaggtcaggagttcgagaccagcctatccaacatagtgaaacttcatctctgctttaaatacaaaaaattagccggacgtggtggcgggcacctataatcctagctacttgggaggctgaggctggagaatcgcttgaacccaggaggtggaggttgcagtgagctgagatcgtgacactgcactccagcctgggcgacagagcaagactccatctcaaaaataaataaataaaataaaataaataaataaaaaagaaaattacggtgctacaagacgaggaggaactacacagaagcctcttcattcaagaaatgaaagctcctgagttcggatatctatcttaaaagcagtagtatgctattgaagaattgtaagcaaagggtgtcttgatcacattcatctgtcaaatagctctttattggtgaggttatgagaatgtattgaaagtaatgtaatcaaagcaaaagaggtcagttgcttggattaagggtgttggctaagaagataaataattgattcgtatgttattctgggacccctagaagccaaagaaaacggaaaataagaccaattataaaattcttattttcagagacaagaaatgccttcaggaaaagggaatttttttgtataattgtctactaaaagaaaatgttcacttatgactttagtgtatatagaccaatttatttagctttaaagtgaaattaatttcaggatatttggtagtaagttttagcaaaacctaaagaaaatagtaaagcacacatttctgttattgatacataatgatcagatatatttccatgataaatgtgatattataaagcacaacttttaaaaaacatttttctagagattatgccttaatttcagcctgtggaacatttctttaggagatattcatggctgctctgtgtccaactacatttgggagtcacctcatactgaatccttttatatactgggtcacttgcaaaggcttaattgagcatttgactgtcatatgccacagaatggatcggacactataaataaaacacaaaagagagtttgtcttttctgggcttcatcttcttaaaaaaatcagctattagacaagcatatgtaagtagtcaagaattatgataaattttctaaataaaaataagtgcatgagagagcgtaagagtatttatttaattcaggtttgggatcaggaaggtctcactgtggaatatttatctaaaatgtaaagggtgaaccaagaaaacagtgatgtggaagagcattagaaaatctggaagaaacacatgtagctgaagcaaagattatgcttattttgaagaaccttttagctgcagtaaataaaagacaccaaattacctccaattctgtaaagcagccttcatgactattcttcactttgttcacaatttattatctccagcccgtactaaatagataacatcatctcctacttcactgggggcttgaagggagaaaacagtgaactaaacttttacaagacattatttgtccagctggaaataaaaagtagaaaaaacatagaactttctatgtatagaggttataaagaccttaattgctttttaatttgtttagttcatgcatcctttgtcagtctgataaaagctgtgggactcctcagaaaaatacacagtgaatatcctttacatacaaccttttacataaaaatccagcagttcaaatgctcctgcaatccattcataagccattcataatccattcctaaaccagcttttggttaagtatccctgctttcaagtatcttgataaaatagtaaaaggaccagaagatacataaatataaatagaaaagtaaatagaagtgtgtgtctgctttactagaattttgaaatatcatgtttaaactataaattttaaatttagtttatggcttaagtacagatcatatattcccataaatgtgagtatatacatttatgtgcaaaccttcgctcacaaactcatatgcttagtgtttgagatttctcagtcctggactgagagttgggaaaaagttatgttttctttaacattctctcatagaaccaaaataataggagaatcagaaaaacataggcctttacattttggcttgagatcagcttctcgccatacctctagtacctcagacaaattacttaacatgtttgtacctatattttatctactttaaaatagaaaagaatacctaacacaaattgttcttatgaggataatatatgaacattgactgaaagatttaagctttttttacttaaaattatcctgttatagatagccttttctcaagaagtacataaaaataataatagtaaagctttgtgaccacaaaaagctacctacagtatatgtatgatgtttaacatatataacttgatatatataatatgacatatgcttgatatatataattagacatatgcttgtctaatagctgatttttttaagaagatgaagcccagaaaagacaaactctcttttgtgttttatttatagtgtccgatccattctgtggcatatgatagtcaaatgctcaattaagcctttgcaagtgacccagtatataaaaggattcagtaagaggtgactcccaaatgtagttggacacagagcagccatgagtatctcctaaagaaatgtatatatataatatcgagttatatataatatatatgttataatatagaatagaatattctataataatatagtatagaatagaataatattctatactatcatttaatatgaaactcacatagactatatttgtagctgtgggtaaatacatgtatgtaattttggtatatatacgtggcttatgagggtttttatggagacatgaatatggtgttaactaaattattataagtccaatgagctttgtgagatggccagtcgaagcaaacaaattccatgtatctccgaagccatttcctctagattgactgaaaaaaaatcaatttcctttaataaacatattttacaagctttgtagctatcacttacttcgtggttaaagtttacatctatggaagattacacagtaactttgtgctcacatgattgagtatcttaggggtttttatagatacatacttaaatatgtcagggaacttcatagttgtatgattggatgtactgggaacttcttgctccttctccttaatttgtgaaatcaagagacagagttactgcaaatttaaacttgagtaagtcctttgctctacttcatttttctcccgagaggcttctttttttttaaacgtccttttgtagaggcaaaatgtaaatattctctgaactctacttctgtatcttaccgtgaagaataataattagctcattaatttcaatttttgtaatatgcttaggtcaacaagattacttctaagggctcctcatcaaatacccctgtgtactttaggttcttttacttttagcaaggctgattcaaagttttttaattcataacttttttaaaaatttttccgagagtcacattgtatctcctttatactgacgtttattatcaggctgtttttttttgagatggtgtctcactatgatgcccaggctggcctggaactcctgggctcaagttattctcccacttcagtcccccaggtagctgggattataggcgtgagacacaattcctgggtttatcattttgtaaagctggagcaatcagttaagaatggagaagcaacagggccgcacggtggctcacgcctgtaatcctaacactttgggaggccgaggctggtggatcatgaggtcaagagatcgagaccatcctggccaacatggtgaaaccccgtctctactaaaaatagaaaaattagctgggtgtggtggtgcgtgcctgtagtcccagctacttgggaggctgaggcaggagaagtgcttaaacctgggaggcagaggttgcagtgagccgagatcgtgacactgcactccagcctgggtgacagagcaagactctgtctcaaaaaaaaaaaaaaaaaaatgaattgagtagcaatagatatcatgagcctcctcatggcgccaatattcgtttgaacccgccaacttcacatttagatatatgtgtctacgttgctggatgggccaggctatttgctcatctctcagttattttactatcctgtttcatctttttccataacactgttacactcacctttttgtgtcacttttaccagagccagtcattaatgaacaagaaatgtctttatttcatttcaaaaaagcaaaatatttctttgaaaattaaacagttaatttccaagccactcattaaagttattttattataagttttaatatcagaattataaaaatatttaatatgtcatctggtaattaatatttattcttttttttgagatggagtctcgctctgtcgcccaggctggagtgcagtggcgcgatgtcggctcactgcaagctccgcctcccgggtttacaccattctcctgcctcagcctcccgagtagctcttagcagcttcttaattaaagaatccatagctctctaatgcacatacgattgtgacatatttattcgttactttaagatcctcccccagtgttgaattctaccaattgcaaggtgcttccatggctttggacaaagtacagaagaattaaataacttcacagccttcatggaattcacagtaaggcagatcccatattaactcaattaaaatatatttagtcaaagccagatgcagtggctcacacctgtgatcccagaactttgggaggcggaggcggatggatcatttgaagtcaggagttcgacaccagcttgatcaacatggtgagacccctgtctctactaaaaatagaaaaattagctgcatgcctgtaatcacaactagtctggaggctgagacaggagaattgcttgaatcctccgggaggtaaaggttgcagtgagctgagatttcaccactgcactccagcctgagtgacagagactccatctcaaaaagcaataaaaataaaataaaatatattgagttgaatactgaaataggggtaactttgggaagctatgggccgcaaagcagagaatgatgcattcagtttgggggagctaagattagtttcgtaaaggaggtgacatcttgaagacatctagaatttcaatagacatagaaaaaattcatcgtaagcagagggactagtgaatataaagaagtcataaagatccaaaaagaactcagaaataatcaagaaggtgagggtagctacatcataattataagagccaactttattgagtacttcctttgtcaccatgtgctaagttctgtattttaatatcctcattgaatgcttgaaataatttctatgaagaaagatctgttttatctttattttactgggaggctgtgaaatatgcctaaggtcacacagctatcacatggcaaaaacaagattcaaacccccacagtttctaattttaaagcctcagcataatgaacacagtattgtactgaacagaatgaatgaatgtgagtagaaaagacatttctgagaacaaagctggaaatgtatcatacaaatcaaataaacatttcttgagaaatccttggggaagagggcaatataacctctcaaacagtagccagaatcatcaacacaaatatgtattttaagttctcacaattggtctcgccatatgaactaaatgctagatatttacttgcttaatgctaccaatgaattttcaaatctttccaaggtgttaataattttattgcttttttataccaagagcaagaatcaaatgttagttgctattgatgtttacattttaaataacaactttaatttagcctacaatatttagcaattacacaggaatcctctgaaagcttttaaccagccccagaagtaaactggctttggatgctaatctcttgagctttcctgactgacaagtttcctccctagaggaggggaattggcctgtctcctaaattttgcatggcctaaagcagtgagtttagaagcacctgtgtttcctggcaacaaacataacatttgtggaaaagtctaattatttaaattcctctgcatttttctaattgaggataaagtgctgcattctaccttcgcattcttattttattccttggccctttaaataaaaaaatacataaaatgatgtggtcagctaaaatatattggacaaacaaaacccccttcctttatctccctctatcgctctctatgtatatatattatatacatatataaaatatatataaacatatatatgaaaacagatatttgtgtgtatatatacactaagagatattatagtttaaatattttttaacatacactttaaaatctaacagcttggattttaatattgggtcagtctttctaaagtgtttaatattttagtttggaagtattaattagcaattcatgaatgagtaattaaaagtgctttagggggcctttcacatcctataataaataccaaaccttttaccacatttcatactataaaatcttggaaccccattatataactatgagttattaatttctgttacctacttttaaaatgggaacatatgttattaacaggtgttgctttgaaatctatattagcaaatgttctaccttataattagtttttgacttatcacaaaaaagtattttattttttttaattacatagtcacatttcaaggttaactttaaaaaattctaaattatctgattttcatgggaaagagatttgatatttgtgccttagcattttggtatttttctctttctgtatagcaaacctttgaatgatagtctgtctgaattcacagtgaagaaaatgatcagaatattgactgtcaacagataatttagaaggttcaatcctatgataatcagggatattttccttatgtaaatgtgttgatttatcaagttcagctatgtcattgattacatctaggcttcaggccttctgtgaactgccagctctactcaattctggcttgtgaatgttatcacatattttagtcaaatcagaggttatattatacacatctgacatttttctctttgtactaataactttttttctttttttgtttttacatcatggcataagatcaacactaaattttaggagtgcatagtaagtattaccatagtgtaatgctatgccaattgttttctaacttaatatttgcaaaactgggttttatggttgtttctatgcgaattgagtgcctctacagaattttatccctgagagtatatgagtggtgagtgataagagatactgaatgtctcagaacatactagcatctgacagcctattggtaagatagtgtaagtaaagaggataaggaaaatctgacttgaaaggagaataaaatctgattggacagtctgtagccaagtttgcatattatggatttacaaaatgaggttgttttgaattcttgattaatgaaacataaactgagttgttttaatattgcgtgccatttgaaataaaatgcattttgtcacaaccctagaaatgggaggttatgtgttgtaaaatattcttgttcccatctagaagacaccatattttatagagaacagtggctgaagcttgttttactaggaacaagtatggtgtaaggaaataacaataattaatactggtggcacttagtgctatagtaaaagtaaatttctaattagaaaataattaccataaaatactgaattatatctttgtaaggcctttagaaattgaatcactaatttaatatataagtaagtcaatattatttttatgagaaaatggacaacttacgaagttgttgttatgttttcaggccatattccatttttcaccaaacaagttatttccctgatacactcacttaaatcatcagtaatacatataggtttaaaaatgttttgtacaattctgaaagcctatcttagtttaatgaaacataataccataaagcttccctttcctccaacatttgagctacaataaaacaaccttgtacaactgataacaattaactcaccacccccaccccattgcagtcattagaattcattactaaaagctcatttgtttatggtaaaataaagtataagggttttgaaaccaccactgcaaaattaggactgagacagtgaaagagatctaacttaactgactccatcttgcttctaacctccactaatttatagtttatcgtttaaacaaacatcataacagccctttcccaaagcagaccttcttgcctggggactagattgcctctgtaggactaacatcagccacagtattagaaattatggtttaggagtcatgcagctggaggcaacaagattctgacccccaccaaactgctcctaagatcagtgcttgagataatttgcagaccctgcacttgatggatcagctggcactacccatatcaataaactggctcatctgatcttgtggcctccacccaggaactgactcagcgcaagaagacagctccaactccctgtgatttcatctctgaccagtcagcactcctggctcactggcttcccccgacccaccaagttatccttaaaaactctgttccccgaatgcctggggagaccgatttgctgatttgagtaataacaaaactccagtgtcccacacagccagctctgcatgaattactctttcttcattgcaattcccctgtcttgctgagtcagctctgtctaggcagtgggcaaggtgaaccccttgggtggttacaaatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataagggtaagaaattcttatcagtcaagtttctggtctctctctctctctctctctttctctgcattgttaaatagtaaactatttgtctcctctgcaagggtttggttaatagaaagaaggatttgtgagactaatcttagcacatctgatgtagtttgtgctaagaatttgtctttctgtgttatgtaatggagagagggatatcacgtgatagaacgtgggttaggacacccataagtctgcttttcaagtcagcttgggaggctggtcagctacaaactttgctacaggtccctgaaaccaatactctatgaaatttctctgtcttgttttgtgtccttaagagcttaaccttgtgaccatgtggggatactttcttttggtttctaccatccagaggacaggaattttggggttcatgtcatagttactcctaagatttttcttgagcagttaaaagccttgcaagcctgaaactggcttctctaggctccttctgggaaaagcagtagaaatttctcaacgctgtatatagctcagtagctaaggctttgtcttttgacagtggtggcctgggttcaattgttggcttctggaatgattcctttctgatttgttatttgtgtagctttgccatttattaagtttcttttctgatttcctctcttgaattttcctttctctggactaccttgtggagattctaaatcttgtaaaaagaaacttcttactatgtctttgcagcacctaggaggtttcctttggtaaagttcagaagctaaaaatattgtccacttggcatggctaaaattaggtaataagagatctaaaagaatttcttttttaaagagcactatggttaaaagtcagcttaattaagagtggataaacaagctatagatatatttaaaaggcctttatgtttttctcttcttggaacttgtttttttggaaaaagttttttcttctcagccgactgaattatttttctccatttttttctcttttttaatttttttgtcttgccactcttaacgcacacgtgagtccctaagataacttctggtagcctgggactcattgggaaaaacagaggaggcaccacagaacccgttttagggaaaaaaaaaaaaaactgttttccacatgaaaccccaggaattaaaaacagatggatccctctcaaaatcaaagactctgctctgtttttcattgtgttatctgatggttttgagttttggggatatcagaaattacttcacattatgagggagctttagtgtgtaataactagataggaaatatactttaagggatggctaatggtagttatacagggatacttgactctttgcacacttggatccagagaagcatgcttttggtcacccggaagataaggaaacattcctcaccctccactgggagatcagactcccatgaaggacgggctgattacaaaatgggctgattgactttgggttgccttgcaatgaaatgcagggtatggccgggtgccgtggctcgtgcttgtaatccaagcactttgggaggctgcactttgggaggccgaggagggcggatcacttgaggtcagcagtttgagaccagcctggccaacatggtgaaaccccgtctctaagaaaaatacaaaaattagccaggcgtggtggcacatgcctgtaatcccagctacttgagaggctaaggcaggagaatcccttgaacccaggaggcggaggttgcagtgagctgagatagcaccactgcactccagcctgggtgacagagcgagactccgtcttaaaaagaaagaaagaaacaaaaataagaaaagaaatgtagggtagaagcactgtactgtcttctcccgtagtatttctctccttttgggttgcagtataaaatggtgcccttaatttgggagttctgtctttgccttcagctgtgattaagccttagaaatgcatactttcctggccctgttcctccaaaggctccaccctgaagccagtaatctgattaagaaactggcaaataaaaagtcttatcagtgccaaatcttctgtctgtatttacatgtgtttttgtgtgtgtgtgtgtgtgtgtgtgtgtgtgtgtgatgtttataaaagagctctgattaattggcttggaaaataagtgcttaaataaaaaaatattttgtcagaaaaatagaaactttgatgactttttgttcacatgactttagtaatcttttggcaataaagacaattttaaagattattgttaaagtaaaatatcttgaaaatgtagacatttggtctaaattaaggtcagctatcagatttgctaaattctttaaggtcaaactgtttccttgactttggaaaattgttcaatttatttactttggagcattatattatagatgaggcctggggacacgtggagagctatgcccctagctatgctgaaaagagtcagaccttatcttcacttctgtctgatgtcctaggctccatccctagcatataattaaaatagcttttttatcaggtttttcactaaaaatcaaagttgctaagagttaacattgtaacatgaaatcgaggttactggagaaacagttttacatacaaggtgtgtagggaatgtgtttttggtgaaagataataaggcataggaatatggcttttgttgaagagaatgtaattttgtctagttcagaggttttaaagactgtcttaaactaaaagagtaacggaacgaaactgagggtttaagcaaagtgaaaagggtttatacagggttgatcctgaaaaaaaaaattctgtgggtataaacaagttggctaagatttgaaaaaggttatttagctttttctataggttaaaatattaaagtcatactgtggggccagaatctgggcccatgtgtccaaataacagggtcttcttagaaaattgatctgctgtttaatggaaaattataaagcgttctaaaaagtttatgagaatgtcaccttgtggtcaaactaattaaaactggatagatacataaaattttatttaaaaactagctttagcattaaagatgcactaatgcgaacatgaaatttggttttctcttttgaagacgatttttttgtaacgttaaaagataatgaaagggtttggctttctcctttgggtaaatggcaggggaaaaggggagagagaagagacaaattcagttatcctcatgctgtctttattgggtcttgtttggaaagctaagtctcctctgtcagaataaaggtttttcttttaagattttggagttatcgttttggtcaaatgaatgacttatggtgacctgggattctattttgtgatatccagtgttttaaacctttgatatttggcaaactttccaaaatcaaattataaattatgtctctttctggcctaatcttttagatattaggtcctctaaagtccaaaaatgacatttggcgtattttgcataaaaatcatacaggaaacattgtcaaatatgaaatggtgtttggctttttgggggctatatttgtgtaaatatatgattgacatatgttctgagattatgtaaaactcctataattctaatatgacttagtatatgttatcagtaataattgtaattatgttaaatggctatgtgccacagaggtaacaaatttccttgtcgattgtgtctttaactctggctactctacaatgtttgtgtcgtccacaggcaattgttgtctcatttttgtcctcttaaaagatggttttataggccgggcatggtggctcatgcctgtaatcccagcacgttaggaggccgaggtgggcagatcacctgaggtcgggagttcaagaccagcctgaccaacatggagaaaccccatctctactaaaaatacaaaatcattcctgtaatcccagctactcgggagaccgaggcaggagaatcgcttgaacctaggaggcggaggttgcggtgagccaagatcatgccattgcactccagcctgggcaacaagagagaaactctgtctcaaaaaaaaatggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtggtaagtaaagaatgtcactttctaacaggcccaggaaccccaagttatcttgggacctcaagaggagaggactttggtcaactcataggtatttgagggtacaaacccatggctgggctcggctttcaaaaagtcttatctgagattcttcatggaacagagttccatcaaagccaatttaaaaagcctaagtgaaaaataattattcttgctgcacttcatgcaaataatcaggccaagtacagtaagactaaaatgcattttataagcaaatcatttctatcatgatttgtttttaataaaaatggggactgaacagagaaatattatgcttcaaaagaaaatctatagtaaactattagctattcttgaggttaattcttcagtttagactaaattctaaattgtttgtgggttagaagttcccaaactaatgatttcaaatgtttgcttttaaaattgggaattgtacttctcatcctaggactcattataccttatagtaggctattcacataaacactgtagtaaaactatagatgagagtaataatgtttctgccacgcaagccttggaagcccaattaggcctgcatgaatccactcaaacagttgcaaagcagttccactcttctcaccttggagttcgttcccattcccgctacttcccccatcagcaggaagaagccagagcgatcgacggccttttcccatctttatagcctataccttagggttaaagtgttagaaaacccaaaggaagggattgaaaccacctttgcaaaattaggtctgagacagtgaaaacaatctaacttaactgactccatcttgcttctaacctccaagctgtcttcgttcattcctgggcataggctgaactaactttgggagaaacttagtttacagtttaaagatggtaacagccctttcccagagcaaaattccttcttgcctgggacttgcgtttgtaggactaacatcagccacagtgttagaaattatggtttaggagtcatgcagctggaggcaacaagattctgacccccaccaaactgctcctaagatcagtgcttgagatattttgcagaccctgcacttgatggatcagctggcaccacccagatcaataaactggctcatctgatcttgtggcctccacccaggaactgactcagcgcaagaagacagctccgactccctgtgatttcatctctgaccagtcagcactcctggctcactggcttccccccacccaccaagttatccttaaaaactctgctccccgaatgcttggggagactgatttgagtaataataaaacttcggtctcccgcacagctggctctgagggagttactctttctctattgcaattcccctgtcttgatgaatcggctctgtccaggcagcaggcgagttgaacctcttgggcggtcacagttttgacctagtaaagctttcattttcttgctttgccctatggcctaatttataatatacataaccaaaagccttagcttctagtaaatagtatttattaaagtgctatataaacgttacattttagggtaaccaacttttcttgttttatttttgtttgtttttgtttttcaggaatttctcagttttaaaatttaaagtcccatatcccacaaacctgcttagcccccaggcacaccagacactcgatcaccctaaagttctagtttattttgggatccttgcatcccttaaaattacatacaagatgttgggtatacatacatactgcaattgccatcaggttcaccttgcccactctctagacagagttgatttatcaagacagggaaattgcaatagagaaagagtaattcatgcagagcaggctgtatgggagactggagttttattattactcaaatcagtctccctgagcatttggggaccagggtttttaaggacaatttggtgggtggggagcagccagtggtcagaagtaatgattggttggatcagagatgaaatcatagggagtcaaagctgtcttgccctgagtcagttcctgagtggggggtcataggatgagatgagccagtttattgatctgtgtggtaccagttgatccatcgagtgcagggtctgcaaaacgtctcaagcactgatcttaggctttacaatggtgactttatgcccaggagcaatttggggagaagcagtatcttgtagtctctagctgcatgactactaaaccgtaatttctaatcttttggctattttgttagtcctacaaaggcagtctagtccccaggcaagaaggaggttggttttggggaagggttgtcattgcctttgttttaaaccataagctataaactaagttcctcccaaagttatttcagcttacccccaggaatgagcaaggacagcctggggcttagatgcaagagggagttggttacatcagatctctttcactatttcagttataattttgcaatggtggtttcaatacctgaatgcattttcgtaagacaaagcttcaatgccaaaacatctaagatatcccaatacggtattaattcatttgctcggtattaattcatttgctgttgctataaaacagaatacctgaaactaggttacttatttcaaaaaggaacttatttcttacagttatggaggctcagaatgtatctgcacaataggttcttctttcctgctgcccaggtagagctgatttatcaagacaagggaattgcaatggagagttttatacatgtacagccaccagctaagcagaagatcagagttttactattactcaaatcagtctcctcaagaagtctgaggctagggttttcaagatcggtttggggaaaggcatgtggaaagctacgcaataggtgcttgctgctgactggtagggattgcaatcataggactgtgggcaagggtcctcctgtgcactgagtctcttctgggcggggccacaggagcagttggcaggtgcaggtggagccatcagtcatcagacatgaaatatatctgaacagatatctcaaaaggccaatcttaagttctacaatagtgatgttgtctgcaagagtagttggggaagtcgcgtgtcttgtgacctctggaataatggctggcaatcctgtatgtctacaccgcagcagaatttagtttcccctatcctcctagcctggtggtctctcattagctctacaaacgcggttgagttttggggaagggctattgtcatttaaactataaatgtctcccaaagttagcttggcataagcccaggaataattaagagcagcttgaaggctaaaggcaagagaggagttggctagattagatccctttcacttccatcattttctcaccgttataatttttgcaaagaccatttcaagaagtcccaggtcaaaaggacacatctggtgagggccttcttgctggtgggaactctctacagggtcccaatggcctggggcatcacatggcaggagggctgtgtatgctaacttgctagctcaggtctctcttcttatcaagccaccagtgccattcccatgataatgcattaatccattaactcattaatccattagggcagaactttcatgatccaagtgcctcttaaaggcctcccctctcaatactgccacactgggggttaaattttggaggggataaatagtgaaaccatagcaaccactgaatcaaaggagttaaatgctatttttaaaaatgatgctaaaagacaaaaaaaaaaaatatagtgttaaaagaaaaacttgagccaaattaaagttaaaggagtttaattgagcaatgaacgatttgcgaatcaggcagccctcagaattacagcagattcagagagactccaggggtgccttgtggtcagaataaatttatagacaaaaaaaagtaaagtgacatgtagaaatcggaagtgagatgcagaaacagctggattggttacagctcgctgtttgccttatttgaacacagtttgaacaatcagcagtgtataactggctgaagaatggcggctgggattggccaagactgagtgattgtcacaggcccatactcctaagttagtttttcaatcttgtctacctattgagataggttgtagttcatccacagggactcaaatatagaagtacggagtccttctcaggccgtatttagtttgctttaacaatagactttatgggaaaatggtattttgttaaatgcaaaataataagttagagaaacactttagtgtttataatttttaatattgactgttagccttagctgtttatttatttatttatttatttatttatttatttatttatttgagacagagttttgctctcgttgtccaggatggagtgcggtgatgcgatctcggctcactgcaacctccgcctgccaggttcaagtgattctcctgcctcagcctctcgagtagctaggattacgggcacccgccaccaagcccggctaattttttgtgtttttagtagagacggggtttcaccacattggccaggctggtctcgaactcctgacctcaggtgacccacccacctcagcctcccaaagtgctgggattacaggcatgagccaccacgcccacctgccttagctgtttaatatgtaactcatggcttggtatagttcctgagatttggagaggcaaactgaggtttgaatcctgtcttcaaacttattggcagttgggcctgatcaagttgcttaacatttttgtgactcattctccttacatacaaagtggagaaattttgcctatttttaaatagaattgtacaggacagagaaaaatgtattttaagcctcttagtgctttgtgatatatagcaggcaatatttaaatggtaactattattattgataatagtaagtatgtatttatgtgcttcacagttttacaattaaacatgtccctctcagggtttcttactatattcttacctagagctgtgacatattaaaccaccttgcaccaaaactgaacaattggtatactgaggataaacattacttttttattcagtagatatcactggataattttgttataaatctctgacagtaaagtgaaagattatgtatatcagttaaaactgataaataacattaaaaagaaatttctgaattgaacatcttttgctctaaattttctggccaaatagggatacctcaaaggaaaatggccggtgaatttgtatacagataattaaatagtagttttagtcagtaaatcaggaggtccaaataataagtagaaccagggacatagcatgatggaaattatgctgcccagttttcaaaaacattgatggtaataaacagctgtgtaacataaaagctggtatgagaacttggtcaaattctttttacctgagttgagaaaaggtatcatctccccatattctactccaaactgatgaaatgctcaccgagctgctccgtagcctggctggttacctcactgaaatttcacccttggaggccttatgaccttttaacttattccacagctagattccaccattatccaaatcaatggtgcatttacaggtgattcagaagttatttagagaagattctgacatgttcaataaaaattccaaatttctcaggaattacttttagacatctctaaatgaataacagagaggttatgtgaaatccttgtgtaattatctgtgcccagatttttttgtcgttgtttgtttttggtttttgaaacagagtttcactcttatcgcccaggctggagtgcagtggtgcgatcgtggctcactgcaacctccatctcccaggttcaaatgattctcctacctcagcctcccgagtagctaggattacaggtgcctgcgaccacacctggctaatttttgtatttttagtagagaaggggtttcactatgctgaccaggctagtcttaaactcctgacctcaggtgatccgcctgccttggcctcccaaagtgctgggattacaggcgtgagccaccgcgctgggcctgtgaccagatttcttaaccatcacatgcctttggacttgccattcaatgttccatttagtagattttgatacattgaaaaatcactatgaacacattttcaagtctagctggcttcatttttgtcctctaaatggcactaaatagaatctgtgattgtgacagtgcctttgctttaatctaccagctatttttgaaagatatataacttaattgaaaaatagtacaatcttttcacttagaatctttacgaaaaatgtaaaagatgctttgccagtctgaatagttaattgagtttgactgtaccgggtaagatgcaaaagagtgtgtctatggcaactctttatctcataaaaaatttaaagggcctttatttaatgtgactccttttaaaattcatttaatggcgtaagtaaaactggatatataattagagtctaagataaaagcataataattgaaataagataatatgaagaagctcacacaacaatgattgggcttcaaatgaatatattctttaagctcagctgaactcttgtaagttgtattttttcactatgatgtaataataatggtatgtggatgacaattatactactttataaatgtaaggtgtcttatagtgtactaggatctttcctatgcattatcaaatctgaatctccaattagccctggatatttgtatatccttttttttttttttttttttaatcaggacagagtctcactctgttgcccaggctggagtgaagtggcgtgatctcagctcactgcaaccactgcctcccagatagctgggactacaggcatgtgccaccacacttggctaatttttgtatttttagtggaaacggggtttcaccatgttggccaggcttgttttgaactcctggcctcaagtcatctgccacctcggcctcccaaagtgctgggattacaggtgtgagccaccaagtccggcctgtatgtccattttttagaaaaggaaactgagcacaaagaggttgagtaacttgttcaagatcacataattagtaagtgataaagtcacactcaaacccaggtattctaacttcaagtataatgttcttttctctgtgttccttctttgtataatagagagcaatgagtatgtaggaagggcagaatagctgcacagatctttacaatatgtctcacaataatgctgtgctttcaaaagacttgatttaatcattttgtttcctcattcactggtctattcattcaggctaagggggcccttttttctagatagatttgctttcaccatttcattcccttgtcaatattcgccatcttagaataattgtgttttcattctcccgcttgaaaaaagatgcttaggtaattctttatttaagaagtaaagaaacattatcaatattgatatagatatgaacatatatatatatatatatatatatatatatatatatagagagagagagagagagagagagagagagagagatggatagatacagatatagatacctcaaatccaggaagaaggaactagattttttaattatacaaaaataaaatactcttttttaatttttttcttttaccttttgtgttctttacataagatcaaatgaataaatacatttatttaataaggaagcttattggtagttcctgtagtatttactgtctattaagcatcaacctaggaattgtaccataacttttgtttaaatacaattcttctattgatgcagtaagagctgtcagtcatagtgctgggaatgccagaggggaagtcatccctgacaacattttttattgcactattaatacgtacaagttgacgttcaagtgtgtgtatgtatgtgtgcgtgtacataggcacacagaaacatcatatatacatgtgactacgtaaaaaaatacacttaaacatatctgtttactctgtaagtgaataatcatttatttcaatgtttagatgagattttaacatattagaatggcttcatttttctttctaggcaatctgctagcaggctttttccagcaacctattcttcccccatctttttgatattataccaagatttctgcctccatttttgttgatgtaattatcccggcataattttgaaaaaagatttcctggcaatgtaaatccacaagattgttgatatggcttgagctcaaatgatgcttctatccgatttgtttacctttcagcttgagcagagttcttgtttcataagaaaaacaggaagagatactatagtagagaaggacttttatggatggttttattttaagtaaatattgcctgtaagggatccaggaattttagtgtttttcttggattccttaaccataatacttagcccagagcaaaactttctctcaaatgatggtaaaaaatctaattctattaaatcctgattattctgtgagctaccttggaatacattgcctatgagtttttctgctaagaaatggacttcgtttattgctcattttcccaaaatcaaggaatgctgttgttcttcaatttagatagatgttgacaaggtcctcttcatagcagcaggtgttaggctataattgctcattatagaattatgttttgcttgaaggaactcaggaaacaagaaaagcatgttttctgtgtatatgaattctggttgaaaaattgaaagaatgacactaggaatagtatgtaaattggcagaatttgtcatttcattgtgcaactagtattttaaaaggcaataaatcaacgtgaacatccttgggaaatcagtctccttcttaggcctaacttgcaaagtacccccttaccattgtatttttttaagatagaaattgagattagagcaacacggggagcaaaatattggcagatgaacttgttgaaggagatgaaaaacaagaagctatagaaatagattggccaatagtgctgagcaactactcaactgcaaaaatggcttgcttttccaagcaatgtgtaaagcaattagcaccaacgtttttattagtttacataaaataatattactttgtaaacacctataaacagagattacctagatagcctaagactattattaagtacaataaaacgttactggtttaaagtaataggtatagaactttgtattgtatggtgcacattcacataactagagaggaaatggaggtctacaagtcaaggttgaattacacacttgtaatccatccttaagggaaaaagcttcactgatcaagatggtactttgcacaaccttgccaattgtttcacaaagctgtaatgatgccacaaataatctttcacctcccatacctaagtaaaccatatttgagttattttctctgctccttcctatacctttcctctttggcatcacaaagtcagatttttaacctacaggttgacataagccaaaaatgttggaagattataaactgcctctctttctctcactgtatgtgttgtgtatatgtgtgtgtacacatatataagcacacacatagatagaactcacacggaaacataagcacatatctacgcactgttgttttgctaccatatccagtgataacgtttattttgaattacatgtattttttttctgaatttaagagtgaaatgaaatagagttttgttagatatacagttattacctatataaaaatgattctgtgcatacttccttggcaaagtacaatacctcctccgctgtcactgccaatgcacaggtgttctttctcctggctgttagactcactgggagaacttagaaaaatatttcagccacagctttactctagcctagatcaattaatcactaccttggccttacaatctactaggcagtccttcccaaactctagaatacagcagaatcccctagaatgcttattaaaaatgcagattctaaagccccattctaaatgatattcttctggtaggtctttacaagtcatgtattcctggggtctttctttgagaaacacaactctaaaaggtctttgttattcccattctgggttttgaattctttctcgaaattgtaacaaaatatatgtactgaaatactgttcctctaacaatctgaagaaattttcagcactagcagcacttgttggcactattgttgttattttgtttaatatttaagacaactaaaagttacagtaatttataatgagaatcagtattatggaatcaaccattaacagttcatctcactaaagaatttttatttttattatttatttatttacttacttatttttgagacagagtctggctctgtcgcccaggctggagtgcagtggtgtgatctcggctcactgcaacctccacctctcgggttcaagcgattctcttgcctcagcttcccaagtagctgggattacagctgcccgtcaccacacccggataatttttttttgtatttttagtagagatgggatttcaccatgttggccaggctagtctggaactcctgatctcaggtgatccacccgccttggcctcccaaagtgctgggattacaggcgtgagccaccgctcctggcctcgctaaagaattaacatcatatgttcactagtactgaggttagttcccaaacactgcactaaaaaaatgaatgaaacaaatgaatgaaaatgtgtttccttagccatattctaagaaaatcacctctttgattattgtaattggaaccatctcttctttctttgcctggaatctttgtaacaaggttatcttctttcatgtcccattccaattagtaatcatttatttctattaaggcttttataatcattcggagaatccacactctttgtgtctgcagtcgctgagttcactcattaaatacagaattttcaacaaccctatttccatcttcattgttattaatacttcaaatttgcttctgttcagaaccacgcacttgtaggatcgagtaggtatacgtgttatccgtacacactctgaaaaactccctgcagacacttactgaacaggaattgcttatttaactgtgttttctgtctctttcatacatgttctctctctactgaagtgattgaaggatgacaaaggtccttatgggtgtttgatggcctgtgaatagctgtcggtctacgaattccctgaaaataatttctccacttgtatgaaaataatttactccgtgacttttcatgttgtattgtcaatcttccttctggttgtatcaggcaggagtcattgttttacatttcattctttagggggcctatgcttggatttctcccattgagaaaaaacaaagcataactctgacataatcgttggtgttaatatcatgaaaacctggaaaaactaaaggcaaggcaaaaaatatgcattcttatgcatgctttatgtgcactatgcccgtacataaacctggcagaactttaggcagaattaaaggtttaaatgggcatcatctatcctctataggccttttagtgtgcttcttatgtcctgaggaccataagaagatctaggagctgagtcctacctaccccacattgctggtaccgttgggggctctatgccattctactccagccagcttcctaagattagtctattacttttgtttcctttttttcttttctttttccttccttccttcctttttttttttttttttgacagagtctcactgttttgtccaggctggagtgcagtggtgtgatctcgtctcactgcaacctctgcctcccaggttcaagcgattctcatgcctcaccctcctgagtagctgggattacaggcgcgcaccaccaggcctggctaatttttattttagtagagacgcggtttcatcacattggccaggttggttttgaactcctgacctcaagtgatctgcccgcctcggcctcccaaagtgctaggattataggcatgagccactgcacctggccttattactctcgtttcctagacattattccacccttcctaatacttagctacctacttttgcttccgtttaaccctctgtaacttgttttaaggtggttttttttttttttaaatcctttggctatgtatgttcttataaagcaaaatttagttgtgtcaattcatgaaatcatattagcattcacttagaggagagtgagaaatgtttcctgctcatctatatagcattgcccatttgcacttagttttgatatttgaggcaaatccttcggttttattgtctaaacacacagttgtaattctaaggaattttacaccaggtcgaaggaggtagcattgcccttgcatactattatgtagggcattgtaatatgacatctgtcatatagtgagatgaggatggctacctctttcacttaaaatagctctggccctttatataaccaaagaaaatataactgaaatgcttggcaagaagtaaagttatgaacaatgggcttccagcatttgctgtatgcctgctggcataggaattccaagcatataatgggtgttctttatataatgaaaagccaattgtgagaccggcttataatctttggtgccagtaggcagcatgtacatttcataatttcatcctaatgttttaagtgatacaaaaatgtcctttttatctactaaagtgcttcacatgttaataaatacatgtaaatttctgtaaagtgatattgtcccttaatgaatcaaactgataattgtttctatctcattaaaagtaatctatatttgaaagtgaagaactctacaaataaaaatatttaacatatcaaacatttgaaatttctaggtattgtaagcacaaatatttatggtcatatttggccagaatgttttccttgtaaatagacttggaatttttatatccactattgtgattggctgtaataatttttcaagtactgtatacacaaaattataattacattttatactaactatgggtgggggctgtcaagtgtaggtaaacaccaatttgcctcatcatctcttttgtaaaacctccaaccaccaaacctaatcgagcaagtttatgcctcctctactgcatgttagcactttttccatgttaatgtaatatttgtacacaaacctgtatcatccaacagagcttctgagaagtagagacctttgcttattagactttcagttcttacttcgtagaatggtggttggccattccatacattttattttattttattttattattatttttttctgagatgaagtctctctctgaccccgaggctgaagtgcagtggcgcgatcttggctcactgcaacctccgcctctgaagttcaagcaattctcccacctcagtctcccaagtagctgggactacaggcacttgccaccatgcccggctaatttttgtgtttttagtagagatggggttttgccatgttggccagactggtcttgaactcctgacttcaggtgatccacccacctcagcctcccaaagtgttgggattacaggcatgagccaccgcgtctggccatcaatgcattttaaataaatgaactaaataatgaatatcatttaagtgcaattctgtttacatttgtttacatctatacttattttaatcaagtatattcggtggtgtcaacaatctgtagcttaacaattttaattgaaagactctaattacatatcactatataatagttaaatagttttcttggatgaaacaaaagagagtgagatagagaaagaagtaacaattaaaggatttcattatgtgatagtcttcctgtgtttttttttccttttagaaagttgccgcaataatagaaaatgtttatttctttttcttactagtagaggtggcatttttgctatagagtgagtgcccttagttcttcatttattaacaaatatttcattctatgtataaaaagtataataaaatcatatagacaatgttacatgaaaaatgaacggattgttattacaccaggaaatcactactgtgccctatcaaaatgagtttgaagtatatatgtgcatatatatgtatatatgggcatgaatctaaggcaatcaattatgtctattttcaatgctctgtgaagaaagaaattggttgcctactgtcacattttatcttagtgatactctttcattaaaatgcacacacgaaaaaattaaaaatgtaaaatctgattttctaagtggacttaggaaggtacagggaacaagtgctagtgcgtgaagtggaaagtatgagagtacatgaagttgaaaatgtgtttgtgtgtgtgtgtattgtagcaggtcatctaggactgcaattttcaaccatatgcccaagccccggcatagagatagtgattcagttggtctggggtggggtatgggcttaggtaatattttatggctctctaggtggttctgatgtgtagtaggggcaaagaactgcctctatgggtgtctaggactgtactgtaactatcagcaattagtgagagggttctttgtaatgcctttgattattcttctagagacatatgttctgtacatcagccggggagcaaaaccagggaattccagaagtggttctcccttaagacttactctgacggtgttagtgttttcataactcgagccttaccctcattctaggaaaaattataattattatctatcttactttccaccctcagtacttaacattttaagggatttagtgaatttttccacttccctttttatatttgttgcaggtaagtcctgttgaatatcatcctcaaatacatgcatattttactgccatggtaacattttctactttttcttctatttttttcatatgtaaattatcattgaaaatttggcagagtctctggtaaccaaagtaatcttgtctgtttctgtgctactagttttattataatttgattcctgttccaaaaatgaagtacagtaataataattttttaaaactcaaattatttgtaggtcaatattaatgactttttattaatgtatatgtatataggtttaacaataagtgaagcagcttataacagtatatattctattaagtagaaatttacacataaagttagaagaactccatgtgcagtgtcctcttatgctcatatataactttctgtttcaaataagagtttcaaaactagagtctgtgtggcacagatggtgaattgatgccataatttccaatctgcttgttagtagagatatgtcatatgtttattgatgattgcaagtatgtttggtgcattaaagcttcatatttagtattataaaaaacttaatgtcatgtggggaaagaagttgctacctttctaaaaattgtagaatagccaggctcaatggcgcacgcctgttatcccagcactttgggaggccgaggcgggtggatcaccggaggccaggagttcaagaccagcctggccaacgtggtgaaaccccatctctactaaaaatacaaaaaccagccaggcgtagtggcgcacgcctgtgatcccagctactcgggaggctgaggcaggagaattgcttgaactcgggaggtggaggttgcagtgagccaagatcacaccactgcactccagcctgggcaacagaacgagactccatctttcaaaaataaatagataaataaataaaaacaaaaattgtagaataaactccttgaattccaggaagaaacaaatattgttgtccagttatgcaattatgcataatgagagttaaatgcacaaagtgatcttaaatgtacatattcaaaaatagaggttggatcaagaattcagattattcaatatcaattcaattccttctgttgtgccatttgaatcctattgccaaagatgattattcatcttgaaaaacagactcccaaattcagagttcctgcattttaatttgcccttatgaaaggaaggattctttccttttctggaatacaatcaacttctgctgagaagaaggaaagtctttattcaatactgaaaatgtgtattttcttaccgtctatttatatggacaataatcaaacttttaattatcttctcacaatacttacagatctatgagaagagttgctatctaaagctggatctttatggagaagagacatgctcaagtgtagcgaataatttttgttacatatcagtattaactaagctttgcaaagtgaatagggaaacttatatttaaaatgtcagggaaaaaaagagttttaagtaaaagggacacctggaactctaaagagactatagctctaaacctgtagctgaattctgccttagatttcgttgacccttaactaggggcaaatgcacaccccattctcagggtttcccacacacctctggaaggaacacaggagcgtatttacagctatcgtctaaccattatagaattcctggggacaaagttgtgtcagccacctttgatttgtagtaaacaggtacaaaaccgcatcatggaattatttctgcttatataatcctcttctgcagtgtctgaatcttggcacctcctctccttcctcctaaccactgcaaaaacaacacccagattaaggcatcggggagaactgaatatctgaatatcaagtactccatatatattgatccatcgaatatgcctacaatatcactactaacctacaagtgtaccaggagttacacctgcagtataacagattaaaacagccttctccaaagctcatcactttgaatgttaaaagattcattttccaccacttaaaatctgcatactatgatctgtgtataaaaagctaaaagatatatccaatttcaaatgtaatgtcatgcaagtgtctactgaatgtgtatatatctttgtaagtgtccctgagcaaaataactttcaacttaacattctttttctcttggatataaaagagaataacgtaacaagagcaaatttgcttttaaatttctgccttgatagcaagttaaagtatttagaaccaacatcctcttaaatgtataatttatataacggatgagtctagaacagcatttccaaatggaaattgtaaagaacattgatcccgtaagatgttgaatgaaaaacaaattgttaaaatgtgataatttcatttccttctttagcgagtcacaactcaaccctgaaatgttttgtagttaaaaaaattgtttaacttagtttaacccaatgtttctgaacctacgtcacaaaggaaatgtttttgtcaagtgatacataactttcaaagagattggatttttttttttttttttttgaaatgaagtttcactcttattgcccaggctggaatgcagtggcatgatcttggctcactgcaacctctgcctcccaggttcaagcgattctcctgcttcagcctcccggttagctgggattacaagtgcatgccaccacgcccggctaattttttttgtatttttagtagagaaaggggtttcactatgttggtcaggctggtctcgaactctagacctcaggtgatccacctgcctctgcctcctaaagtgcagcgattacaggcgtgagccaccacgcctggtcgagactggaattttttgaaacacattttcataaatgaattactggggtactctctgtttattaactatgttagtactgacaaagattatttgctcggccaaaatttattcaggcttcccaaccttctcatagcccagtctgtgcacattctcctaaaatttagttttagcaggccagatcagtttagccagaaaacactcatccttggtatttgattatcctggatatctgatcatgttcctcatcatccaccatcctccaggggatgactggactattttcagcaggagtctcccttacccatgatgcttcctcttaataattttccatccactgacccctaccctgttccttggttataaaattcccatttgcctgtgctgtattcaaattgagctcaatctctctcccctactgcaagaccctattttcacggtccctatacctattgagatggtcttgaataaagcctgccttaccgtgattcagcaagtgacattgaataattttttctttaacagtataaggatcgcacattaccatttgttttgaaagatggtataaaaagactaactgaaaactaatcttggctgggtatcactggcagaaattcttggtcttcaatctatgtagaacagatatttgcattttcttttgaaaatttaatacattgattaaattgtcattttgttataaaaatatgaaatgaagggtacatatgatttttaaaaatttctgtccaccatcaccaaccactatgtgaaaatacacctttgtaagactttttctattctataacataccttcaaaaccaagaagaagtatttgtaggaaattcattgcttttatttgtgaattgataaagggaaaataataagctagggctcgagcttcagaacagggtgatggttttatatctctctcaaaagtactgcaaggtaggttgtttcaatactattaacaaccccagggttccctgacatcttctattcccagcttccattctcaaaaattatatcgaggccatgagttggactcctcagccctagcaaaagattattcatttgctctgtaacccttcttgaaccccttttcctggtagctgtgcccaataaatccgacttatatatctttgggagttggagagagagagagagagagagaaagaaagtgagacagagagagatagagggaaattattttagctaagaaaatttacagtcacaataatatgagagtctctgaataagggataaaagaatattagacgagacatagtctctgccaatggtgattaagtaaacatagtcaaggagaatatggctgtgaccattagtgtgtaagtggttacatctggtgggcaatctccagtcataagtaaaataatctacgagtgagatacaggctaagcaaagatttcataattaggaccgaacaagcactaagtacaaagtcaaacactgataaattgagcttcattaaaactaagaattctatctattataatacactaataacagtgaaaagaaaagtcatggactgggagaaaaatattcacaagacgtatatctgattagaaaacttgtatccataatatataataaactcatacatatcaataaaaagacaacccattttttaaaagttggcaaaatatttgaacaggcacttcataaaagaggacaaagatggtaaaaaacatttgaataggtgcctaacttcattagtaatcaaagaattttgaatacccctatatatgcatccgaatggttaaaatataataagacaatatcaagtattggggagaattggtgcctcagctggagctctcaaatattgctggtttaagtgtaaattaatatttgccaatatctactaaatctaaatttatgccttccttatgagccagcaattcctctcatatgtatgtgttcaaaagaaattagtaggccaggtgtagtggatcatgcctgtaatcccagcactttgggaggccaaagtgggagggtcacttgaagccaggagttttagactatcctgggcaacatagtttgacctcatctctacaaaaaaaaaaaataaaataataataatcaaaattagcctgacatggtggcatgcacctgtagtcccagctactccagaggctgagatgagagaatggcttgagcccaggaagttgaggctgcagggagccgtgattgcaccactacactcctgcctgggacagagtcagaccctgtctcaaaaaaggggagaaattaagtccaccaaaatagcatgcacaaggtagttaatagcaacattttgcataatagcagaacctgatataacttgtgtccctcagaattagaattaaaaatgcggtatagactgggcgaggtggctcacgcctgtaatcctagcactttgggaggcccaggagggcggatcacttgagatcaggagtcagagaccagcctggtcaacatagtgaaaccctgtctctactaaaaatacaaaaaattagccgtgtgtggtggcaggcgcctgtaatcccagctactcaggaggctaaggcaggagaatcgcttgaacccaggaggcagaggttgtagtgagctgagatcatgccactgcacttcagcctgggtgacagagcgagactttgtctcaaaaacaaaaacaaaaaacaaacaaaaaacaaaaattgggtatatccgtggaatattatatagtaataaaaacctgctacttggaagaatatgaacgaacttcataaacacaatgttgactagaagatgaacatttactgtgtgattccatctatatgaagtttgagaactggccaaagttatctataatgattcaggtcagcagagcagtttcttcctgagaggctggtgggaatatagtgtgaattgggaaagagcatgaaggagacttacagggtgctgcaattgttcagaactctttttccttgatacttgcttacagaaatgtgcagaatttttatttcacctagttttctatgcatgcgtagaatctccatagaacacacattttattaagtacgcattcaacttcttctaaaatacctctagtcatagaaaatgtaactttatttctttattccttactttgcctagcccaagctcctacaaaaaaaaagattagttaccatttaattcaaattataaaacagaaccagtcttttaaacagtatcggatacacaagtatctaatctaacttccattgcctatcagtggatgtggctttaatcaagtcttttctaaacaagatggacaggcactgaagaaaaaaaaagtgagccattttatgtgttttaaaatgataatgtgattttgaattttgctattgtagaagctcctaacaatattatctggcatttgttctatctgaataaagccatggcttatattatgtatatatggaatttcccagaatactattgttagacacatcactgagctgtgaaaaaaaaaatcatctctaatttgatcaatatgtacttacacgtatatcattagttgccattgctctcagcctttagtacattttttatgagccccgtgggccatgagcttgctttttcataacagagaacgagaaagaagaaatctcatcagtataataatacccacatcagtagagggcatggttcagaggcaatcttgttgtctgtcacagactccatgatataagctagaaatgataaagagattcgttacaggatactgtaaaagggatattatggtatataaactcattaagtgttaactagatcaaagcaaatatggcagaaaagagtctctgaatactgtagcagagtttattgaatgaatgaacgaacgaatgaatgaatgaatttataaaaagcgcaggggggccggggcgcggtggctcacacctgtaatcccagcactttgggaggctgaggcagacggatcatctgaggtcaggagttagagaccagcctggcaaacatggtaaaaccccgtctctactaaaaatacaaaaaattagccgggcatggtggcgcatgcctgtagtcccagctacttgggaggctgaggcaggagaatcgcttgaaccctggagacagtggttgcagtgagccgagatcgtgccactacactccagcctgggcaaagagagcaaaactccgtctcgaaaagaaaagaaaaaagaaaagaaaaagaaaaaaaaaagagcgcaggggtcagataattgagttagaaggtagaggagtggggatgttaatgcccatgtgagaaaagaggaagaggtattgaaggaatccagcggactttgatgaggaccatgcgggactttctattttcaggaacctaagggaacatcttgctgtaggcagcctggggctgtctccatcaaagaaatgctaatatttacattcattggtttttgttatgtgactgtctatgtgctaaagctgtggttctcaaagtatgtttcagacccgcaatatcacctggaaatttgtaagaaatgtaaattctcgggctgtgcggagacctactagataatgaattctgggagaggtattataagaagttcttcaggggattttgatatagtctctaggttgagagacagtgtagtagacaatacattcattactttatttattcttctccatgattctataaaagagctattgttactgctttgtttacaaatgagaaaactgaggctttgaaagaggctcagtattttgttcaaggtcatatagctggtatccagagatactgggaatagaacccaaatttgtcagactataaaacacggtgctttcagccactcctccagagccagggggataaaaattcattaatttccatgagtatttgtaatagtagcccgcaagtcctggaatacaattataactgctacagcattacctttgaggagaaaatatctcatttccccaattgattgccaaaataaaatgcttaaaatacaaatgtctggttgaagaaaccctttaattttttttcttgcgttcaggcatttgtgtcaggtttaactaatttattttaacttgcaatacagtgttgcctgtagtaacaaataggacattctgctattagtttttaatctcctaccgacttgttattttccactcctgaagctaaacttctttaacaatttctatgctcattgtatctacttccttactcacgtagctacctcaaacaccaataatccggctgcttccacatccttcaactgaaattgattttgtcacggcccaagtcacatcaggcctcatcttaccactctgtagtattgattgttgatcggtccttcctattggaaaaactcttcttccctggcttctaagatattccactattctagttttcctgtctcagggcaactttatcattttcttggagggttgctctcctatcgtaaatctcttttaacgttgagcttcaatcttaatgctcaatcaacatatttttcttgatctcatcaaaatccatagcaataacaactcttaaccatgaccctcagatttttatatccaaccaaaatcattcttttgagctagagacctatccccctgcccatcagttatgctcatgtatgtcacatagttaattcaaaatcagtatatatgagatcaaaaactgccttctaagcaattcttcctccttctctagctcattgaaagacatcatgtgccaaacttctcaggtttgggggtatcattcttgcattctccctcgagatcactgttctaacattaccttggcatcagccatcatgttttgccaggattgttgcagttcccctaaaacagatgttcaatttcccccacccctgtgattcagttttccacatgcagccagaatgttttaaaaagcatattcgattgtgtcatcttccccctagaaaaccttctgcggtttcttcaaaataaatttaactgaataactagttgacttaattcaatgttttccttcgtcacactaattaatcagtattttcatggtcctcgatgctgagggcttaacattcaagaataaatttgtcttatgtttactttaacttataaacttcctttaaatgaaaactaattgttaaatgatttgcaaaataaccagaggcacaaagtctattgtgatcagtggatatgacagaatatattttttgttgttataccatcactttcacaaaactatggaatatatatataggcatataggtgtgtatgtatatatatgtatagatatgtgtatagagacataatttatagaaacattcgtaataaacccctgccaaacatattttgcacgtttgaaatattagttgattggatttgtggtttgtatgtaagttgaacaattaactgatgtgatcattctgtttccatggctgttaccttagtttataccaccttttcacctgagtgattacaatagcctcctgattccttgtctctttatttgccacgttcccttcttcaaacttcccaaatccactttcccaattgttatcaaaaagagttttcctaaaatgtaagtcagataatgctactcattatgccaaattctcattgccccaaaagtgaaatctgaattctataagatgctctaccaatctctccattaattggcctctgcactatctctttacattcaccccttcccacccaccgaacccacccatccctcaagaacgacattgtacgtactaatcatgtcatacaagtcactattctagcttctgttattcttctggaaatgtcatctcccacctcaactttttacccagctaactccagtttatcatttaggtgatgtctcctttttggaacatacctagaattgacgttacaggaggaatatctcttgtgtgtcatctcaacatcccacagtaactatttttttttctttttgttttctttctttcttttctttttttgagatggagtcttgctctgtcacccaggctggagtgcagtggtgtgatctcggctcactgcaacctccgcctcccgagttcaagcgattcttctgtctcagcctcccgagtagctgggactacaggtgcgtgccaccatgcccggctaatttttgtatttttttagtagagacggagtttcaccatattggccaggctggtctcgaactcctgacctcgtgatccgcccgcctcagcctcccaaagttatgggattacaggcatgagccaccgcgcccggcccacagtaactatgttttaacatacatcaaaccactttgcaatttcctgtttacatgtcattatccctcattagtaagcttctaaaaagtatgggcatttatccagttccctatcatctccctagtccccagcacaatgcctgacacttaagtaattacgtgagtaattaaatgagtaattatgacacattcaagcttgttaaactctaaaacttggaaataaggcaaaagaacaagtagatgttcttttattatcatactaaaaagtattgtctaaaagatctaccgacagatagtttaatttgttagggacatgcgtctttgtataacttagtactaacttaaaagataatttttttgtgggtacatagtaggtgcatataatttggaagcacatgagatattttgatacagacatacaatgcatagttatcacatcagaataaatggggcatctattaccttaagcatttatcctttgtgttacaaacaatccagttatactcttagttatttaaaaatgtacaagtaagttattattgactatagtcaccctatagtatttactattgattagggcttagattctgagaaattttacataaatgtacacatttttgttcagtagagagacaagtaatatctttctggcaccctcaaaatatataattttattgcactttttgatgttaatctgttttgtttctaacttagcaatcttgttctagcttctttttctttctgtgactatgtgtgttcagtcccttgaattcccctttgaatcagttttaatttgttgcctgttttgttattagttagttgaataaatgtttccatattatcaggatatgtttataagggaacagcaaatttacttccgtgtgttttaaactatatgagaaacactgagcttggcatcaatagctaattctaggggagaaaaaaagtcattctcgtatatatttggaaaaacagtttttattcctttttgagatattaacagccatttgtatgttgaagattctgagaaacttggaggtgatttaatctgttttgctttgtttaatctaaaatttcaagattattttggttctaggaaattttgctctagaaaaaacagtttggaaacattggtttacttatagctttaaagaacaatattttaaactacaattcttgtgttcgaaatgctgtaaaaatcatttctattaagatttatttcctctaagtgttttgcattcaaataaggtgaaattctgggtctccaaatatacatttcagaaaagtctttgtttagctgtagggaaggcatcctgacttctcatcattatagtcacatagatacactagatttaaaggatatttaggtcgggcgcggtgactcacacttgtaatcccagcactttgggaggccgaggcgggcagatcacctgaggtcaggagttcgagactggcctggccaacatggtaaaaccccgtctctactaaaaatacaaaaattagctgggcgtggtggcacttgcctgtagtcccaacttcttgggaggctgaggcaggagagttgcttgaacccaggaagcggaggttgcagtgagttgagatcgtgccactgaacttccagcctggggaacagagccggtctccgtctcaaaaaaaaaaaaaaaaaaatagagcgtaattatatattttccttattttaaaagggaaaaaatactttccttattttccatatagagtatatcaaaataattacaatcattaagtaaaactaacatttacctgtggtctaaaaaagtcggttgaggccaggcgcaggggctcactcctgtaatcccagcacttcgggagttagaggccagtggatcacttgaagacaggagtttgagaccagcctagccaacgtgatgaaaccccttctctactaaaaatacaacaattagccaggcgtggtggtgggtgcctctaatcccagctacttaggaggctgaggcagaagaatcgcttggacccaggaggaggaggttgcagtgagccgagattgaaacactgcactccagcctgggcgatagagggagattcagtctcaaaaaaaaaaaaaaaaagaaaagtcagttgagatagtgaagatccaaagatatctgctaaaaaagtgtgtgttatctagttttaaaaagaaatgatatgcaaataaaaacattagtgagcagttaaatatttaaagggtacgttacttacattatgggtgtaaagtgtaagtggatttctgaaaacatgagcaccatgtgaacttcagtatttaaacaagtttattgcttttggcttttggatttattgtttttttgaaaatgggtctgagaacggcctagaagaatgggtagacttgacatctaagtctatctcaattctgctcttgagaaaagaggaagaaattgctcagaatgttctatcataattttcttcttgctctttagatttctaaatggctacacaggtattgagaaacacatttttatcttgttatgaacactaaaattcattagccttatatttcctctttccttatagctgtgtcttgtttttgatggcttaacacttttccattctaatcaagctttgtcatgggctatgggctgaagtgccttgtgatggactgatttactttcagtccctgtaatctgtgcccttgaaggctagaggttgaaatcattaaggctctgctgttgcccttgatctctgctcaaagaggctagagattgattggttgacagtggttgacctggacgtctcaaaatgaagccgtgatgaaggaaaatcaagtacacacgttcagaatatttcataatgacatttattctgcgtgcattttttccagcggtatttttgcttctttttttaaaaaaaatctagtttaatcatttctagcccaccctcaccactaccacatgtttattccatttctacattctggggcacttaagaccttttaattccttgaattagtcatttataaatgttgtctgaatattctatcaaagcaaggcagcatagagaacttattattacacacttatcacatgaaaaaattatttattagcaaatatctattcagagcaaacattttgatcaaagttggcctcaattcactaattagttattatgcaaacataacaaacatccaatagaataaatattcactcttttctacagttttttttggaatggtttcagtgctggaaaaaaaaactaaaccaattcatgtaagaaaaagtaaatgtctgttaagagaaaagaccacttttaaatacacgttttaatatttctattttaatttctacttaaaaaggttaaggaggaatattctaaagacgaatatatttgcaaatactgtgggaacactttattgaaccaatttgagaactaagtcaattatattgaatttacatatttggttaaagaaaaaatgagaagtgattagattagttcaatatttaagtgaacttaacagaagtatccaagttcatgttgaccctattgcttcgtattaatattgataattacaaatatacatatatattaattttcaaaaatatagattatgagtgggtaataatagcttctaaaaattcactttggtactattccatagtggccaagtttccttttgttctctggagggaggtggcctaatttaggcaagtttagtatttagagcaaaaaaaaaggcagtctatgcagagattcaatggcatcttaaacctgccccacctatctctcattttttacattgctttttcattatcttttcctttcctttcgagagacttgaatttaatattgtctctcttttccccatgtttgccttttataaatctaagcatttctgccattaatactgtaggttaagaaagtggcagccaccatatttaaggaatagtaaaatctgtaactggggaaatatacagtcttctgagaaactgaaataaatttcaggtaaaaagtatgtgacgtcaattgagtggtgcacgtcgagggatacaaacctaaatacattccaggatgaaaatcgtgataagtttggagctccattttcagggaagtttctgtactgactttagaaacattgcaaccaaacaaatccttgggaactgtagaaaggactctttttagtgttcaggctaagtagacaatgcctacatatttaaagtttcatttggcagacttgacacagtaggcttcatggaacacaagttatgccttccttggtctgagagagagaagactagttctgctcaactgaagttaagatctgaggttcagtgagtccatatagatatcatggaagattgagtgaatacactggccctaaagcaacagaaagagcacaagttgagatacagttttaatccccaatgattggaatcaccactgccagatatcacatcctaattacacattctgcccttcaagctctggcaatacttttcttgcggtgccccctttctttagtttgccatatgaagagtgtggtaattactttccctgcagttgtttaccagttctcattcatttttcaagttttcctttctctctctctccttttttttttttttttttttttttagatggggagtctcgctctgtcagccaggctggagtgcagtagcatgatctcggctcactgcaacctccacctcccgggttcaagcgattctcctgccctcagcctcccgaatagctaggactacaggtgcatgccaccatgcccagctaatttttcttgtatttttagtagagacgggatttcaccatgttgggcacgctggtcttgaactcctgacctcaggtgatccacccgcctcggcctcccaaagtgctgggattacaagtgtgagccaccgctcccagtcgaatttttctttctctaaacaattttcagtgtaaaggtctgctgtgctataaatttgtgacacatgattgtgttgtagttacgactacgtaaggctctatggacaggtttcctttagttctgccagcacagctaaccagctaatataaatataaagaaatgcaactgttgacaccaaatgcagtttccgtttgcctgaacaatcaacaaataaacacaaaatctgaataaacattacaatgtgaatctatgtgtctgtatccataattatataaaattgaattattctaaagaattctatgtttcttaacaaaaatattatatgcatatatacagttaggtttaatagatttgtataagcatttctaattcttagcttccattgatcttcagtgtttcagaatatttatttcaaatcacttttggaagaaagtaagtttacaaattgtgaaaataatacacaaatcagagatccctatttaaaactaatccctacatcgcttcatcaaaatgcctaaaattcttttttggaatgaaattcacagagaattgcaagattcatttcctttacacttttattcactgccaataacttggggatactaagagtgcaggagaagcaggtaattctgagggcgttttggaggaaagcagttttgcattggctaagtttttaaaaaagattaaacatttaagtgccttgttttaaagatttgaatgataatgatttcaggtaattgatttttaagctatatggtaataataagacaaaaataattcatttgtttccttttggaaaatagattttttaaaagataaagatctgttttaatttttgtttttatttctaaggtactgtccaacctaaaaatatgaaagtaggtgtgcataagcttttttaaaaaaaaatcgccagtagtacaaacaaattttatagtccatcatttgcagggctggagggcttgccatatttaaatgtgtgacctgttttgagtatttgggtcaaagagaagggaggcaccagtgtttaaagtggcacaaacagagggaagaatgaaaatacaatcgaatatattcatttttattttcataaataaaagaaagtttaaaaaatctaggtacatcagtaatgttcccttagatagtattattatgtggctattgtttactctcctttgtcagcaacacgatcagtgattttcagcacctgctattgggttaataatggagttagagaagcatgagtttcaatttgtgctcatctactgcaaagtagctatatgaacttgggcagttacttaacctcgctaagctttgtttcctatccatacaatagggtcaagagaagtacctctcttacaaggtctgtgaaaatgaagtatgttcatgtgtttaaagtgtttagtaggtggcacatagtaagcactcaaattatatggactatggccattaccttgacaaactatattctctctccatttcctcatatgtaatgtggattaacacgaagattaaacttaaaaagtgcataaaaatctcagtgtctagcaatttgtagatgttcaacattattaaaattccctcctcaattttgcttactttgctgtactgaatgctatgtgagataggaaaggatatcaattatttgctatgccccttccgggcactaaataaatacatgtttttgttcattcttttactcaatctaaaagttattgagcaccaaataggcatcaggaagtatatggacaagtataggaaacaggattgatatttacaatcaggagaacaattttgagcccccagtcagtcacttgatgttatcctgggcaatcaatggatagagtccaaccactctaagcctcagttttcttatttctacatgttgatagtattaatagttgttataagatttgaaacctgttatggactatagtattttgtgcagacattagtcaaaatcataaattattttggggagcacatttacattcctcacagtgaagccttgggccctacacctttgcactaaattatacatctgtagcaggaaaaaaaaatttcagtatcacacaaatttaagtgggctaaaaatggtattttattaatttttctatagctaaattaaatttctattttggttcctcttttaatttaacaggtttcttaatataccattctcaggaaatcttaataaaattcagtgacttttcaggtctaccggtcacattcaggagttgttaggactctagcctccactctaggattggaataacacaggagtattacttagcttcatggcatcagggccaacttctgattctaggtcaaggacacacagagatgtgacatccaatgtggtctgtggggaagaagatctttgcatgcaggcattggctgaagtgaaccagtacctgcatcccgcccttagttgaactgcctattctgcctccaggatttggggtgtctgtgtcctgattaccacacccttgaaagactgccagcttgctcctcctaacttccatgaccttctcaagcaccgacacatgttagctgcttatcacaaacctgatgagatgctcagacccctgtgaggctaatctacatgcccagtccctttgctctggttgggcactatttttcagcagctccagaacctccttctcttctttaggactttggttccctaagaggacattataatgttcctcttatttgaaaaggtgtgtgtgtgtgtgtcagagggtcaggaccctccccacacccccacacggcttctagctctcacttatctgtaactctctcaacttccccctcttcttctcttggtaggcacctagagcaggtaaaaacttttaaacaggattcttctatatctgtttatgccagaatcatggttcacttacactaaaagcagttgacctctgtcagtgaaatcaagagttgattttgtaattcaagagctctgtatttataaacaaccctaaggcagtgaggaaacagtgcctaacttaccttacttgcaaaggatggaacttaagaatgtggttacaatctcacgaaatacttgtgtgtgtgtgtgtgtgtgtgtgtacgcacctgtgtgtgtgtagttctgaagatggcattgttaggtggtggaggcctataatattatgattctcaacatgtgaattgttatcacaggcaactaatcctattgcctcaggtttacaatctgtaaatgggaaataaaatgcctaatgtttgttctcagcctagttgtgaggattaaatgcaaaatacagcctcaacaaatgtgagttcccttcctcacattcccttgtaaaaaaaggactttccccaccccccttttatttagcatatcaacaattactcctttatttgggactgaacagccttttactaactatccttttgtttctcattttttatattcatgcatagtacaacttatgaaatattttaccccaaatcctcttgggtctgctttatatgcataaccaaataaggcatatttttatacaactattgtgttttatcttaaggtaaatttcaagctaaagtgaaaaatgaattccttctggtattcaggcagaattttccttacgagaagtaggtcaagaaacattgaacgcagaataaatttatctctgaatacggctcttcagctctggattgtttaaggatggcctagaatctacgctgagcattctcttgcatctcctttttcagtatggttctgaattagcactcgggcataaagcatttccttggaattgctcttatttttgtccccatattctgcactccatcgtcaggtaagaaggcaatatgtagcagtcatttaagaaaccagcacataaattatttccgaagttaaatcaatgtgcatcttactggttcagttcacagttaactagaactgctggggcttgcttttatgaattgtcccattccctccttgctttctttttgagactgactcttgctctgtcacccaggctggagtacagtggtgcgatctcagctcactgcaacctcctcctcccgggttcaagtgattctcctgcctaagcctccctagtagctgggattacaggcatgcaccaccacgcccggctaatttttgtatttttagtagagacggggtttcaccacgttggccaggctggtcttgaactcctgacctcaagtgatccacctgcctcggcttcccaaagtactgggattacaggcatgagccactgcgcctgggctctctcttttaaacaatcataaatatgaaattaaatgggctgactggaagcaaattggtctgtaggaacgcccatgaaagtgttccattctgattgttttcccatcctgcagcccctctggcctagtggaagctcctttcgttttgcagatttagattaactggggtaggtgagagagggcagggatggcaggccatttgtctctcatcaccgactgaaaagttgagcctaatatataccttttgctcctctacccaaatgaattacaaaattctaattccctcacacaccggggcctgttgtggggtggggggaggggggagggatagcattaggagatatacctaatgttaaatgacgagttaatgggtgcagcacaccaacatggcacatgtatacatatgtaataaacctgcacgttgtgcacatgtaccctaaaacctaaagtataataataaaaaaaagagttgattgtttttataatctaaaagtaaagacagtttggttttgtcaaaacttctttgttttctatttattttctctatagcttctaaatttgtgttctgcttgtgcatgcgtgtatgcttgcatgcatatgtgtgtgtgttttccttaaagagtaggcaaaaaagggcagaaaatagatcattcccttataaacctgacaagtacctgtttgtttctttcactgtggtaactggaaggctggaaatactgagcacttcagtagtcattctaaaaagattggttcatgtttaatttgtttgactgcccaaacctctaatggttcagtgaaaccttcgtgaggattttaagaaatagatcaggtgatagtttcagttgaagctactaaaaaaagcctttttgttcatattattttattagagtgggaaattgggaattctaaaatgttcccacatttgtcacccgtgttactctggcagccttttgtcatgttcacattttccctgttcgtttgttactgctgctgaatgtactttaatgattctaataggagctatagattgtgcagaagaataacaagcttcaaattaaaaaagaatatatttgcattttgtggcttctaaatattaatacaattgaattgtttttgttgaccactgtacattgacttcccagggtccggtgcatagcaaattcatagatgctccataaaataattatagaaccatgcattcgtgtgtgctgtgttgtggttctgggtactaaggatgtctgcctgagtcctgaatgagtcttaatctccatccaagttgtgtgtttcagagttgggatggtgcaaggaatttgattattaatgtaaactttagataactcatagcatgaataacaactgtacagtagaagaaaaatgcagaaagaataaaaaacacaaacaacagctaaaacaacaacacataaaaaacctcaaataattagagcaacaggctgtgaatgcatttagcaaacatatacccttcacttacttttgggaatccagtaactttctcctctgagttcaatgaaaaatcagtagcacttacgggtgtgatcattaactttgtttacttttttagctttcaatgacattcacgtttgtgttgagatttgttttttctttcctgaacattttatcccattcgccaatccagaaatgatagaataggaaaagaacaactagggctttatgcaagtacagtaaaatctattgatgcccctctacaaaaggctgcaaattggaatggctgaaatcatctgctcgtcttttgtgttgcattttaggactatcaatgaaacttgaaatgatatattaatagaaagtttgaacaggaattatatattgaaaatgtgacagaatgggtagatccaatcatcctaggctgttgagaagggaatatgcctcacagtcttgtactttttagatgaagccttccaatttacctggcagcccacctcatggctcagtgtttagtcatatagcagaggttgttacaattacaaaagttctcttttttttccatggaaaattgatcatttggagcagtagattaatttatttcaattttaaagtatgagaggcatagaggtacattaaaaagaacaaagactttgtagtcagagacatctaagagttgtgtaaacctgagcacataagtagcattttcttatctatatgatgggatggggttggggtaagaatatatatcatataggcagttacaaatataaaccacacatcacgtatggattttttttttagatgaactcatttatttgacatattaaattagacaaagaaatatatatgtaaccagataaaaacaatcacattctcatactacttgaacacaccgcagtggtcaaaaataatggattgtaaaatggaccccaggatttaatgcaaaaaccaccccatacgagaaaagtttcaggcttctaacttcactgaatccagtactaaacgtgcttctttatattcctcagcttcttccaagtctttttcactttctaatatctgttgaagatccaaatatgcggcttccaacctgcgctggcaatctgggatcatcatccgggattcttgtaggatctctgcctgctttttgatgtcataattttcaccatcttcagctctcattttttcaatcttttcttcttgttgttttgcctctttttcatacatcactttttatttgaccaaccgcttcaccacaccggtcttgatcttgatctgtctcacgcgaggatcggccatggtccctcgagccccgcgagaaggaggggcggaaagccggggtaaccgtggagggcgacgcgcagaggcggtagctatttaggcttggtcgccggcgcgcatgcgcaggctgcgcggccacttaaggagtttttataataaatcattatagtgtcataccttccatcaaaggattgagtactcaggtgtgaacattggtaaacaatttttccaatattaacatctgtagtattttaaattatgtgtcattttaaggtactgttattctctttgtaatttaacattttttataatagaaataattttgcaattgctacattaacattttgagttgattattgcttattgttagcaattccattgcatcattttacagattccatcactgtgctgaaacatcccatctgtttgtgaaagttttggatgttttctttagtatctagatgaatctattccttatcttatcagtcagagatattttaaagtccttgtctgttagttcaagcatataggttatctcttagtctggttatgttgatggctttacttcttgataatgggtgtattttgcttagttttatttattttttgcaagtctcattttctttttagtgaatgttagatgtcatgtatagaagaaaaatagagaatgaggtaaatatgtttaatcttggaaataggtatagctttttttctgtcatactgctagtatggggtttgagtcagtggtgttagtattgagctggtttggaggggcgggggttgttgttgctgtagcaaccttcagaacactacagtcttcaaagacctccactgatgggctgctgctatcccgtgcttaatgtaatagtgtctgcggtcctaaagggatttctatcttcttgttccatcctcagttttcagcaagccttatatgcctgtctctcccctagtggtaacagatcattctgtttttattggtgcagaatcctgggccaaagaggttatcatactgctcttccaaagagggtatcttgaccctctctcagtggcttctaccttccccaacccctctgaacaggcgggtcccatgggtggtagagtttagtatctttccttcagtttagtatctttccttaaatcttacgccttttagaagaggagggtctggaaaatgggtttgacttcatgtttgtgtgtcactgaggggagcttcttcctatctcttgtcctacgccttacttttttgcaagttcccaatagaagtttgtggaaaagaattccagaatgagtgcagactccttcggtctgcatttccaaggatgctgaaatgtcataccagcccacacctgacttttaagaatgccttacaattggagctattttctttttcctgctcctacgatgactacttcttcctccagttccctgccaaaggtaaacctttcatgtatccagtctctccttggaggagattgaagtactttggctcacctcgttgccttgtggccacagctatataaatggctcaaaaaataatacgtttttatagatcaccctgctttttctcattgggtggagcaacgttcttatatagcatttttacatcctaagcagaagaggaacttgattatgatggaaagcgtaagtattttaccctcttgggatatccacattcgacatgttaatcattacagttacccttactttagatggaaacaatgaataatacttatttttattagagaaaggccgtagtagataagtgatattttaaaaattgaatttaataaaaatgtattgaggacctgttatctgtgaatcacccaatgggaaaagtcatgaaaagctgaagaaaacacttcattgtatttcagagcttttaatttaaaggtgaagaaaaaaggtgactcaaaagcattttgtatattcagaatccatttgtgaaacctaatttgtgatgttgaaactgagatttggcacactgtccaaaattgcattcaaaagtgtagaacctgctgtcctggcctttttgttttgtttgtttgtttggtggggtggggtggggtgggcgtaggaaggaaaaagaaaagataaggagtgtggtattgactgatagtttattctcaagtgcagtcaccagggagttcgaactgacttctacttttgaagttgaaacatggaagcagggctccaaaattttgtatctcattgaagtaacttagaatactcacacttttatgaatgattgagatacttcctaaaaatttaaaccatgatatctccaacaacggaaaagagggaatatgaaacccccataggctacgggtgtcaatcaaaatagtcttcggagaaatgaaatgttttcttcatttactataaaattgaagaaaaaatttcatttttcttttttttcttttttgagacgaagcctcgctctgtcacccaggctggagtgcagtgacgcgatcttggctcactgcaacttctgcctcctgggttcatgcgattctcctgcctgagacttgcgagtagctgggattacaggtgcatgccaccatgcccggctaatttttgtgttttttagtagagacggggtttcgccatgttggccaagctggtctcgaactcctgacctcaagtgattcacccacctcagctcctagagtgctgggattacagatgtgagtcaccgtgcccagccaaaaggttcatttctcaagttttacaaaacttttcagtcaaaattcacatatctactgtcacataattcatactcaattacattccttcaaaaatgctctcacacaaagtttgaacacatcgaggcaggtggtttgaaacatccatcccaaagttgagctgggagtcaaggtgacaagaatggcccatgagcagtgagatgtctaccaatgccgggctccggggcaaacaactaacattaagtgcaaaggattaaacttgttaattaggagaaaataaaagcaggcatttgcttattttattattgagtttatattaatagtaatcacttccattcatattagatgcaaaggaacttttaatattctatgcactgacttaaacttatttcttaatccctttcatctccttataatgatgcatatgagattattggaggtttggaggtatgcactaatgcaaagtgatgagctgtaaccaaaaagtaaccaagaaaataaaatcacaatttcatgcatgtatttatatttgtcttctatggcaaaccatggggatattgaaatatgaaatttcaaataccctctttattatgttagatgcattatttttaacaatagaagccttaaataaaatattaagatacatttgtattttgacacttaactgcccttggcattgtgcatttaaacttttggtgtctagcaaagttaaagggagactgtctttaaatacatatatattgatagtgccattttgttagacatgtcatctttcgaatgtaatgatattgttcacacattgattttattgatgatgttaaatcaaaatggtttctgcaattagtaacttctataaaacaaacatattaaaaggaaatcatacttcctattgtagtataccaatttatttttccatttaggaatagctatgctccctctcatgttttgttttgtataccttactaaattaaatattcattttattctttaccagtttccatcacagacacaatcagtattatttaaatttcagcaagaaactaaacaagacttacaagtttttcagtgctaatgatttttttttctcattaagtctgagtctaatgaaactaaacagaaagttctggttggattccttggtcacccctatctgtgtttgtgaattcctataattggcatgaattgaaagttcttgttatcactgatagtaacccagagacaattccaatttgggtttaaatggccctatgcagacaagggtaactgaacaaaccaaaacagcttcatgtgtttatggcagataaataccaattaagtactagaaatgacatcagggttttttttttttcctgtatagtttcaagttaagagactttttctcccttgagtttgcagatatagagcatcatgaccttacaagaggaaggagagcaacttcccatctgaatgagagatggaaaaattatatgaaatagaactaattctactgttaagcagtaaactacttattacttgagtattaattaggacacttggctacaaataacttataccaaatttgaactatctttatcaaatgtggaatttattccaaaggatacgtttattctaaggattaaaatgtttctcaaggcaggttagggcaaattgcagtacacctcagaaaatgcaatcaaaaccttccaggactctctgtcacatctccttctctctaaactatcttttttattgcagattggcttccgctgttcctcatgtagcagaccatgattgccaacattcccttatatttatatctcgcagttgaaggattcagggagagcctgattctaagacccaagtctaaattctttaaatacatacgtatgtatgtgtatatgtatatgtatgtatatatatatatacacacacatgcattcatgtttagatagacatacacagacatatatgtgaattacattgaattacatatgaattacatttctatttaatgtattcaatgtaggttacaatgcaacgttatagaccttttcatccattacaggtaggaatgtggtttaatatggaatttttgagaagtaatttgaaaatatgtaccaaaacttacggagatgatttttcacctaaatccattataatttttgagactcttttctaaggtaataatcccacatttgggtggaggctttatctatattgatagtaattgcaagactattttaatagcaaaaattatgagaccatttttcaaggttccaaaaaaaagcagaacggtaatttttatgggaacaaagaagacaatgcttctagatatttaaattgtgtttgaacaacattggaaaacctgttattttaaatgaagaaagtaaggtgtctaactacttgtgcaatgcaattacaattatgcaaggaaaatgcaaaggaaatatatcaaactttaaatcctaaagcttttaatactcactttttctctagtttctaaaatttggctaataaacataaatttaatttataaattaattgaccttggcattgtataaacatcagggtaaataatgcatctgtctctctgtctctctctcgctctctttattcaactttatcctaaagcatcatactaattacaatctattggttttagtttgactcctcagctaggttactcaaacaatgaaagactacttttaatctctgaagatgtttctttatcttgaattttgatttcctaatcaatgaatacttgtctaaatttagtattaagttcacacacatcttttctcttttttggattactttgccaatcaataatgttcctcttttagcggttactggttatttctactgatctctgctgagagtttattctcagacactttcataccacgctttgaaaatactggtttccaagctgtgaattcactgtatctatgcagaaaggagtgatttgtttcttgtatggcatgatgttttttatatcctgtgaaaaccatcaattccacatttgagtggttccttcatgacatgggctgctctaactaaagaaaaatgtgcattaaaaatatgtgtccgattaaggcattaaaatatcttaagcagtcaggtagcaaacaaatctttctgagttccaattactgtattacattatgtcaatacttactgtcaaagtacattacagaaaaaggctgggctcttttcagaaagggcattgcaatataatgggtgacaagaaactgcatctgtgtatatggaagcacaagaaactaacaacaacaaaaaaatagtgcccaatcctaggtggctgaagagtaatatctaagagaatatgaagaaaacccattatttattccctaggccagataaggagccctggctttctctggcatagctgcagtgtatataattatacctctttcagtgccaattactgtgtgtatatccataaaaagaatggtacaatggtgacagagatgaagagcagatctcttaaataaacatgtaaaaaaaagcaaagtaaagaaaaataataaaaacaggtctattgctgttaatgccactgttccagaaaaaagtaaaacagagatcattaatatccataagagccagaataatgtctatatttttcatccaacatttttcaaaccatggagcccttttagaatctgctgatgactgtggactctcatatatacacactcataaaattttgcccacaattttaggggtttattccatagtcgtattgaaagcccatagatttcaggataggaataacaatgttgattactcatttggggccagacactttctatgccatataaagataatggcttatttagtcctcacaacgacactatgagatagttattattttagtacctattttacagatgagaaaactaaaggaaagaaaagttatgtaaataaattgagaaaactcagccagtaagcggcaaaactggactttaaatccaggccgtatgattccagagcatactccaacaaggactgtaaactgcatcctgcagaaacaaataaacaaacaaaaacctagaataaagaagcagatgatagagttttagaactggcggaacacatagaaattatcttttccaaattctatgttttaaagttgaggaaattgtattccacataattaaatgattaacagaagcccatagagcaagttagtgttagagccagggttcaagtgggaacattcatccaaagctcatgacaaagctacaccgatattattatcattattctacaggtgaggaaacagaggcacactgttaataagtagcagaactacctttcgaacccagataggcaggttcaaagctaaaactaccatattactgtaattcaggaaagccattccctttataattcgtttagtaggcgctcggaatgatcaaatctttaaattagaaaattcgaatgtcttcaatttacaaactttggaaattctggagattctactttacaatcattttaatgttctctaatcaaaaactaatgttttcagtgtgctacaattcatgaattttatattcatatcagaatataaaattatacacatgcatatatgaactttatatgttatatatgtatgaagcttatgtatgtatataacaatatgtatatgaacacaacctgaatacatatgtatatatagataaccattcaaacattttaaattggctatagaggaaagcaatttgccatttgacttaaagtcttttgtaatgactagaatttaaaataaagtttacaatttatgaagatgaaataaaactatacttaaaatgctgtttttcgaaacagaaaattcccttaaaacctcaaaatctattgtttgttttatataataaaaatccaaattttttctacaatgtctaaatcttttgtaattctgttatattttcctctacaagttcaactcagtgatacctaagtgcaaacaataaggctagtatgagagctttttttttttgagacggagtctcgctctgtcgcccaggctggagtgcagtggcgcgatctcggctcactgcaagctccgcctcccgggttcagccattctcctgtctcagcctcccaagtagctgagactacaggtgcccgccaccacgcccggctagtttttttttttttttgtatttttagtagagacggggtttcaccgtgtttgccaggagggtctcgatctcctgaccttgtgatccgcccacctcggcctcccaaagtgccgggattacaggcgtgagccaccgcgcctggccaaaagttacttaatttgcatgccaacctacactcacatctattaaatgattagtcaatcaagatatagacaaaactcatctattggcaatgtacactgagggacgtgttctcggtgtagtcctgtcaccgatcttagtacagaaataaataccttttttaatccagtggcataataaacctgagaaaagagaagtctttcattaagaatcttggaagaagcagtcgttaaccacttgtcatcagtattagcaactcaagctgaataaaaattgattgtgtgactctggaccttctttgctctgccacttggataatctattagcattggcacctgattaactctcaaaactgtctcctcttttgattagctcccaggatttcttttgtattctcagtaataattttccaaacccttttctaaaagactgactctaatgttcttttactgactgcaaagtttcccgtcagtgctgaaaacatgtttggccttcattcctatttataatttttggcttgatctttcataaacactggcttaagacttccgtatttggtgaacagggagtgaatgattactccgaaactttatttctgttttaagtgctttcagtatttggcacaaggtggaaatgagcaggctcagtactgaccattgctattacaataactcactgcatttccttaaaacttattttccacttaaattgttttctacattgatttctgtctgtgctaatacttggccatgtatgagaacaacctgcttgttttaatgtttaaattttgaatggtatggtaaggagaaagaccaagatttaaaagataatatattctgaaagggcaatttttggaaagcttttaatacttcatttaaaacccattcttcagcttattttaaatttaatgatggaatacaaccctctcttttttaaatgaagaggttatatacattccatcattattgaattttattctatgggccacatttactatttacctgctatattagtcagctttattataggctaatgctctgtaaaaaacaaatccaaatctcaatgacttataagaacaaacatttatttcttattcacatgtcaggttcaattttgtattgagtacaggtcagctctatgcatctctccttttaggaacagaggctacctgaggcgtgtacttcccctgacaaagggaggaaggaccaagaaaagtgaaaacactttatgattcttaagcccctagctcagaattgacacactctcatatctgactgtgttccactggtcaaggcaagtcacatgaccaaggccacatcagtgagtgggatgtgtaatccacccatggtgaaccatggcaagtggaaaggaggaagaaaaagaaaccgatgagcaaataatgtaaactaccaacttgttcaagaagttctaatgcaattaaatatatagtcaggaataataatactgatctctattggcacttactttgtactaagtctttgcttaagactactttcgatgctttacaggatacctcatcaaagtgaagctaagagtttttttaccacgattatttcctcttttcagactggaaatcttgggtttggtgtggcttatgagtcttttctttctttgttttgtttgtttgtttgtttgtttttgagatggagtcttgaactcctgtcggggctggagtgcagtggcatgatcttggctcactgcaacctcagcctcccaggttcaagtgattctcctgcgtcagcctcccaagtagctgggatttcaggtgtccgccaccacgcccggctaatctttttatttttagtagagacggggcttcactgcgttgatcaggctggtctcgaactcctgacctcatgctgcgtccacctgggcctcccaaagtgctgggattacagacatgagagactgcacccggcctatgagtcttttctaacactgcataactagtgcatgatcaagccaagaaatgtgggcccaaattccactacagagagcagacaataacgatgctcctatgggccattctggattacatatcccatgcaacaattgaggagccctacagggcatgcttagcaattgttccattgtttttttttttttttgtcctttttaatacatagacttctgtccctcgtttattgagggttgcccctgggagaactaaatctctatcacttctggactgccctgcaaatgggcttaccaagccctcctaaactgaagaaagccttaacacaaagaaacagagagatgtggatgcttgtggtgaggaatcttcagcatccacagaatccgttcactatagttataggtgaactcagggatggctcggtgaaataagggatgaggcattatcctcatctactatgccattttattaacctttactccatagtgtaagttgagtaaatacatcttgtgatttaaatatccccttataatccaggccctgtgtttgaccatttgtctgtttctaaagcatctcattaacagtatgtttggaaatggctgttgtgtgtcgtgcacatttggctgtttgctttccttttggtttgcaaagaagtattttgcaacccataaaaatagataaatatacaccacagaacaatgtatttttttaaattttcaggggagaatttgaatcttttaaaagtaatattgagtaggcagctgtatggaaacaggcatctagttagcagttctgctacaatatccaagtagttaatttcacctctaaattacactggagaccttgaccttattttgatttattctgtcataattagtctatggttattactttaacaaaaataagtcatctttctcatgaacactaccaaagcacatttcaagtctgcatactaattaatagtaacttatttttactcctaacaagtctacacccacatactcatgtttaaacaagatgagatatttgaaatcactttataaattataatgcaccacagaaatatccattatttccattattactaaaaacttacttcattcttttgagcatgaggaggtataatttatgtgaatatcatttcatattttgtttttatctttcaaatcgagaagacttgaattttttgcatatttacaaatactataaaaatcctactaattattaacatggctgccacgtagcaatcgtgtctattttatgaaataatgtcatttatacagaagacccacgggaagttgtaatatatttggaagtaaagatttataggttttgtctatttttttctctttctcagcattaatatgtcatacatgtgtcacatttagtcttcacaattcagtatctttattactattaccatgaaacaaatagaggcaatgagacacagagaggttaagtaacttactcaaggccacagagataatgagatgtgaaactggagttggaactcaggttatttgactctgaaatgagtgtatgatgtaaccccggcctgcattgtatctaacacatgcaattttaagaggataagaattaactgtttgcacaatctaccagatggcactgtttttccaactgagaccacttaacaccttttcatatactcttggagttctgatcattcttccactctaatacatttcttcaatctcattgtcattatgtcctacttcatgcaacttcgattaattcttcacaagtatatttctacaatacttgtgctatgtttccaatgtatagagcattgcaatttttatgaatatacaactatgcgattatgttaggttctcaccataactccaatttgctaatggagcataaattctgtgattaagtggcagggaatgggagagaacttttattcaatatgagctgacatggctttccaatctggtttctgagtccaacaactccctacaataaaaaagcaattgacctacctgagaaagaagtggcgtttgcagtggaggcaaaggaacagacaggtcatccatagcattttacattgtgtcagaagcatgacagtcatgaaagatgaagtaaagggcaattatatcatattacagagtgaaattcacctagagaaataaaggcagattgtttgcaagaaatattctttctcttaattttttattcattgtagtgatgaaaataagtagcaatatttcagttccaaggctaaattttggggagaagtcattgaaagttagttttatgtctaatgggtgctcaatggataatttaggaaatgaattggtgacagaaggtctataattaacagagtagtttgagcagtatgatgaagtgcagggggaaagcattggtctaggacttagtagatctgagatttaattacagtattgattagtcacttgatttattcaacaaacccttactaagtacctatttctgcttcagtataccatgtttggtgccaggagttgcaaagacataataattctcccatctaagtgtggtcacatttaggaggtaatgagtgggatttgggctgcattattggaagacaacaaactaattttctgtttgtgtgtgtgtatgtgtgtatgtgtgagtgtaagcaagatgagatatttgaaatcactttataaattataatgcacacacaattaaagtatctgtgtgtccatacacatacagttaaagtatttatgtgtgtaacacatatgcataattagaaaaaagcctacacatatgtatatatcagaaggattgattgataagttatgccagggagataagtgtgattgtgaaaaccctcacattcgacctagatcttaatagtgagtgtcctcattctagggagtgcatgaacaaaggactaaagcaagaaagcatatgatttatttatggagaaatttggcttgtgtgactaaggcagacctggtagatgtatataaggtttgggatatgggtgactgccaacaggcctaatcgataatatgtttagaggagtacactggagtcaaattgtgaaggcccttatatgccattctgaataatctagcctgtaacctcatcagagaagctctggatttttcaagttagttctcttaatatatgattgtaacagaactgtagtttctccatcagggaatttagctttatcattgattatccatgatccaactcccctaactccacatataattaataattagtacttaccaatactaccccgtaaacacatcttgaatgcacctactccttttccagccccactgccattcattaatgcaagtcatgcttacttctcacgtggattataggtataatcagctcatgtgtcttcttatttacagtttatccccaaatattctctacactgtgaaatttatttctaaaagccaagcctgacattgctatttccctacttaaaattctgctttgatttcgaactgccctctggctatattttcaggctcttcataaataggttgatgataatttcactttttctagggtcatctctgccatttttatcctcctccaccatctctaggtctgggaaaggaccatactctttctctcacatcctgacactttcacctgctcttttgattttctggagttctcttttctaccacttgtctctctgctcttaattaactttcaaaactcagctgagatgtcacttcatcaaggaagctctggatttttcaaggtagtttccttaatatatgattgtcacatgactgtagtttcttcatcaggcaacttatctgtatatttgtatcaacatacccttttgttgtgtctgcttctctcactaagctagaaggaaaaaagctagagacactgcctttctcacagttgtttttctaccacctagtaggtgtcagtacacatttgtcacttaatagccttaaatatgaaatgtaatttattagtttcctattgctgctataaaattaccacaaatttagtggcttaaaattatatacatttattctcagacagttctgcaggtcagaaatccaaactggaacttactggactcaaatcatgatgccagaagggctgtgtacttttggatgctccaggggagaatctgtctccttgccttttccattttctagagaattcccacgttatttggctcacggccttcttcgtacatcttcaaaaccagccacctcggaccaagtccttctcatagtgctttctaattctccccttatgccaacatttccccccttttaaggacccctgtgattaaatcctgcccactcagataatctgggataatctccctatcaaaagttagctaattagaaagtctaattctatctgcaataattccactttgccatgtaacataatttattcacagatgtcagggattagcacgtggccatttttgaggaggcattattctgcctaccagagtttaatagaattaatatctgcagaggagaaaaatgagaagaggactaaaaagtaaatctggtcttcgttaacttaaaacacctttattgagcactactatgtaacacattctatgctaagtgctgggattacagctctgatccagacagtcactctcttggaaatgagaaaggatgtaggtgatgttattaagaacaacttttgtaggatgatgagcagtgaagactgcattacattgactgtaaagcgaatgggaaataaagaaatatctttgacatgaacagcttttctgttcttcgtgcagaagtttaattattttagacctcctcattgtaagctgaccactaacgtcacctcaggcggtagaaaaatcccataatcaaagactattactcagatttaatagaaagcatttttcataccattttccattgcagcctcctccactctgcactgccattttgtaatattaatggcacagtaaatccactttctaaatatgtcctaaatttgtttccttcctttataatgctccaaaatatcacataaccttatctaatgtttatcattaatcttccatatttttcatttttttctcatgtttgatggaagcagagaatagactgaacttaattgctctcccatattacttcatagttctttattttcttttctttcttttttttttttttttttttttttttttttttttgagacggagtctcctctgtcccccaggccggagcgcagtggcacgatcttggctcactgcaagttgcgcctcccaggttcacgccccagtagctgggactacaggcgcccgccaccacgcccggctaattttttgtatttttagtagagacggggtttcaccgtgttagccaggatggtcttgatctcctgacctcatgatccgcccacctcggcctcccaaagtgctgggattacaggcgtgagccactgcgcccggcttcatagttctttctttaagtgaaattaactcatcccattgcatttcttcactacgtgagtttctaaactggtatcaactttaatattcccttccccttttaaagatacattttctgtgtcacattagggatgaagatcttcaattaacatattaactagcccccaaggaaatatcatttaaaaaatgtttttctaggccgaatgtggtggctcatgcctgtagtcctagcactttgggaggctgagacagaaggattgatggagtccaggagtttgagaccagcctgggcaacatggggagaccccatctttacaaaagaaaaaaaattaaaaattagacagatgtggtgatgtgtgcctagagtcctagctactgaggaggcagaggtgagagaattgcttgagcccaggggtctgaagttacagtgagctgtgatggttccaatgcactccagcctggggaacagagcgagaccttgtgtcaaaaaaattttattttcttgtacagattatggttaattgctttgtgtaatgggaataattgttagtgtttatagaactgtttttctgtttttttttttcccccagtttttaaatgctttcacttacattgtttatctgatggcagagaagaggtcttaaggaggctctccagcatctcgctcctaactctcattgcaatttcattccatgccactccctttctcacattttagagtgcaacaaaacagaattgcataatgaatgagcgtgtactttcagtttcttatcactctgtccttgtccttactgtctgctcagtgagattcatctttatcctcctcctacctttattccttctttactttctctcatccttctgaactcaacctacccattaccttctccaaaatatcttttctaacacccatgtggctacatattcctttctccatgctcctataatacgctttaaatttatatatatttttgtttatgcaaaatgtttcatatttatctatgatgtgtctattatctactaggctaagagctctcccagactgaatcttgtttatattttcagtaactagtgcaatgtccaggtcatagtaagcattctgtaaatatttattttataaattattacacgagtaaatgatctcattatatcctgtcaatagctccatgagttaaagagcaattaatattctcatttcacagttaaagacgctaaggcttggcaattttaaggccacaattctaataagtcctgcaaagccactggaagccagttccacagatttaatgttccctcagtttgcccagtatcattcttctgcagtaacttgctcttgtgaatcaagaatattgcaatttaatatatcccacatttatattcctgagggactaaggaatataaaagttaataacagggtaaaagttcattgtactaatcttaaaaaatatgaaaggccacatatactgaataaaaataactttattagaaggggttaaagattactgagaggaaatacaatttttatgtcatgttagaaagctaattttatatgggatttccccgtagagagaataaaataaaacgttggtcagtttttgcaatttatgaagtagtggttcttcacttcttgacatctccagggaacagttttcaagtaaattttcctaagagagattttcttctttgcctctcttattaatatgcacatgcatgtttttattagtaaaataaaatcagttataaacaaaccctaaaggaaatgaaatagaatatgtgctgcttgaaatgactaaacaggagcatataatcattttgtaataaaacagctatcactttattcttttctcatttgctttgttgctgattgcacattaatatgttttactatagactatgtgactacagaaatagacatcatgttaacgtatcaaaatagtttctagaacaatttatatatgtgtgatgtgtatgtatggtggctttaggttaactaagggtatacagcttaaaatagtcaacttttaagcaatatgacaaatagcaataaaaatatatcaattcaagtaaatacgtataaaattttagcatactaaaataaaaattaaaaggcatatgaccacttgggaaaatatgtccattcactgactaaaagtgagtagcttaattttgatcgttaacttggattttatggttataggagttttctgcaaggaggtcagtgaactctatgaaactatatgcaaatatgtatgtgtagacatttttctatagagaaggttcattattttcatcagataatcaaatggagcccatgacttgaaatgtttaagaattaccaatatataattatctcattccaattaattttaaaatattaaatgctcaatagataaatgagccaggatgtaaacaagtattttgacaaaaataggaacatacagaataaataaatgcatgaaacatcttctacttcattagtaatcaaattaattatgattaaagcaaacatcaaggatctccttacatctaaacaaagcagcaataccgtaaaagactaaagcaacgaaactcctatgaatgacatacctgcggctgagatgataattcccaacctcattctttctgctaccagtagaagtgggtgtgatcacttggaaagtattataaagatatttagcaaaagtcataaaggttttcataatgttgaactgataattttttcgaagacaattataaaaacaaaaaagaagtgagtgcatgagcatgtttattgtgatttagtctctaatagcaaacaaaaggaaagagcagcttatatgagatttatgataaaataagtgaaaaagaaagaatattattttggttataagaaatatgtatttatggggaatttaaaagtgtggacacaaaaattttgattgatttttggatgttaaaatgtttccataatgatatataagacgaaaattgaaataccaaatatcaattagtaaatgtaaaagcattattatttgaagtattaacaaccatatcatccagcaccattaaagaaggctcattattcagttctagatcagttcatacagacaaataagttatgcattgccaaattccaggacgctattcacataggttacaacatacatggaacctccttgagttgttcaaaatagaagctctgatttcatggttgttttgcatttgcgttaatatgttcaccttttgtgactctgattatcttatggtattctgtattgttaattatgcaattataatgtaaatgatagatatctggtcaatgtgaaaagccatggactttgattcagaaaatctgtatcaagttcatttctgtcacttaatagctttattccttctcagcttgtgtttatgtataaagtagtaaattacatacagattgagaagacataattaaaacaaacttatgaatagtaaggcactaagaattgttatgtattttataataataatacaattaattgtattaataattattatgttgaagaaaatatatgctactataccaaaataagacaataattcattgaagacatttttcttgtattaaagacgtagaggtgagagaggacaactagcaaagatgtttatatgttgaagctcacatttagtgttatttacacagtaaataagtaacactttgcacataatgtcaaggttttcgtgctgccttcgatgcttacctaaaaattactccttgtccatataattgaaaagaataaaaattttattctactacgtatttttcacttaaaagcctctagattaaatcacttcaaaagacctcatattgagcttttggcagagggttttgggtatgtttcaaagacatctgaatgtatgctttcaactgactcatttactctctgctttctgacagaaagtacgcatgcacatgtaggaaatataagtggaattgcaaataaggtcatttacttttaggaatatatgtatatactactgataaatgatgcgttgaccaatcttcctccataaagtctatgaagatggtttaattttgaccatttgaaatgttccatttctttttaaaattattttggaagggctagtattaattttatgaaagtaaagatttgaaggaggctagaataggtttgaaaactattactatctgtttttatttattcacccttgtcaacaaaggaaatacttccatattgtagctaagatttatcatataccatatgaataatgttgatattgaacatacatatagaagcttgtgtgaataacataattaaataagaaaaatgtattttgtaatgctaaataaaatttctcacctaagatgacagtttgaaatttatttattcactgttatttctcatattgactaaaggaatctacttatagattagtattgtgatttaaagataaacagatatttttggtgcatgcatatatttgttatgcgaaagtgattccttatgtttttaagagaagcaacggagatttactactgaaaaatatatgagagcaaatatgattactttgtaaagggcattttaataacggttcttttaatccaagtagataaaatataaaatttatcaattttaaatatctctcagatgcattcatttactgaacattaactaatatgattatatttacaataattaaaaaaatagtcttttgcttggagaaaaacattttaatatatcaagattgatgatttttctgtccatttgacttaatactaatttccagtttaggggcaaaaagatcatttgtagaagcatgaattcagtgaagctgttttttaataatttttctccctaatcccttagtataaatctttggggacttttttctttgagtatttatatgtaaggcatgaagagtatcatttgcatttttatttgaaatgttctgacttttagatgaaaagaggtcctagaaattttagagttgtagaatctccccttccttaaagcatgcacgtatttgtcagatgtattttctgagctcttaatttgttcagacagtgtgctaagttctgggaagcaaagataactaaaccatgctcctgctcatcaggaaacctcttccatagtgagatcaggcccatgttagagtatgtagatgctgcaaaggaaggaataatcatttctccatggttgggtggatggcatggggaaaggctccgaaatagtttttcggagtaaatgacagctgagagtttcttttaattatactggagtatctattcataactggcgaataaatactgttattcagaggagactatttttttataatcatacagtatttgaacgactatgggtttggtcatattaattgtttttcagatattacaaatctgaggcgggatcttgctctgtcgcccacgctggagtgcagtgccatgatctcggctcactgcaacctccacctcctggattcaaatgattctcctgcctcagcctcccaagtagctgggattacaggtgcatgccaccatgcctggctaatttttgtattttcagtagagatggggtttcgccatgttggcctggctggtctcaaactactggcctcaagtgatccgtcctcactggcctcccaaactgttgggatcacaggcgtgagccaccgcgcctggccatttttcagaagtaattttaatttggatgccccaaaccagcatcactcatgtttaattccatttatcaatgaatgtaatactaaatgtaaaaaaacactaacacatcataatggaaagttactttggttgtaaaatatgaattatatttaaagttgcttcctaacttttatttttttattttgcattttagatgaaagagaagatgttcaaaagaaaacattcacaaaatgggtaaatgcacaattttctaaggtaagaatggtttgttactttacttttaagatctaagttgtgaaattttcaaaatggactatgtacctgtgtatcttaaaaatccgttttatttctctcatagtgtcattttattttagctgtgcaaatctggaaatattatgttcactcttatttaaggagtaagcagcagaagatatggcaaagatacactatttaattatataaaatgtatatctttgattcttcttgacaatgtgagtttctttaatgacatgagtcctcagagtttatagctgcaatcttccatcaagtagctagaatatgtcacccagcagaagaagatatgagggaattttgttgtgaaaattatcatttttttgtccctcttggtctttaccaagttcaagaaaagcaatataattgctttgggtgtattcagccactatagtttagagcatatttcaaatgattaaagacaataagttcatcttgtttttgtgcaggcttcaatccatactcttaatatttacttaatttgcaaatacaactcaatttttaatcaatagcgtgactctagatgattataggtggacacagagcaagatattcttaccttgaaaactagtattaggaatgcaatatatggaggtttattgggatgtcaaagtttaaaagacttgcattttaattattattctcgatttgggtaaatcaatcaaatgtttggtgagtcggttttcttatgtttccatcatgaatgtttgtatatgtatatattgattgcttaattgagacatcaaatctagataatggaaaaataaagctaataaaatatggcccttaaacccaaggctttaagagtggcatagttttgatagtggatattttgtttcttattgtaatgatttaaagagtcactaaaagtgaaaatttctactaaaatgcctgaaactcttaatagctatgaattactccctctatgggtctgattttgtaaaattcatgataatggagccaaaacaatccactaggagatccaatctcaaaagttctcccttttctatgacaaacatttttagaatatcgtctattctttgtggtatttggtagtagaatgttgccatgtactctttaatttaacttactgaattttaactaataaaagttcattttatttacttgctgaataattaacaaatttctattacagacgtaaacagaaacatgtattttaaaaacgttttttaaatcctcaactttttttagctaagtgaaataaaatataacaacacaaatatagaagaataaataaaaagtaaacctaggatatttaggaaagttattcataattctccgaatatttataagatggttatatatagtttaattgctgtatatactggcatcattgacatttttaagttttggaattctgaagcagacaagagacatattttcaaacaaacatacagacaaatcagaattgtgaagaaattttctgaaatagtaaatgtaacaatactctgaatctttgaattgaactagagtaatttttaaaaggtgtgtaaacatgacaagtactgtgtatcctcattcccgcaagttgaaatagatcttcgctctgtgcattaaccttttccattatcatttatcacaactcacctgttaatatagaaatcaaagcttgatatccaatccatcctctatttatatattgttagcactgcctcagagcaattcggtatatttttttctgtccttatgaatgcccatatcttaaaactgtaaaatattcacatatatgagcacatttattgttttcttccaaaatatttgcatcctctaactcaactcacacttttcatttatattacaaatgttctccctaagtctgttataactgatcaggagagtcaccattctttcaagtacagaaattctattatcaagcatatcctaggtgtcaggaatagaaataaaagtttacaaagacagaggagaaaacttatttaaaggtaaaatgtatatatacctgtgcactaacttctaattttgagaacttgcaaagaatctttttcctcttttcttattcttttctgtcaaaacttagctaagtgactgcattcttttagacacttttgaagaagatgggaatttagaggaagctagttgattcagtttaagccacttggtgaaaccaaaagataaacataattgtgatatatatatcatttggcaatttattgcatcgctgcatgcctttcagcagaattctagccctgtaggatacacagattagttgaagtggaatctcctgaactcatggaacctacacagttatttgggagtttttggttaattgataaatggagttagaactgagtgggctcagtgtgggtggtctgagaaggcagtaatctgagctagagggaatctggtaacctttatgaagaaagctctaaaatgtgagcccatcaaaggcaggaatgtatatcttctatataatctcattgtttattactagtacactatataaatataataaatatactaggtcagtagtacaaatcattaaatctatgctaactgtagaaacagaagaaaaactgggtggaaaaattgtgttgaagaagactttaaaaagagaaaaaagagaatgaaaaattctgtctgtgtggtaaattagacacaggcacacacacattcatacaactataaaaatgcctcactaataaatctaactcatattcatttttatagtcgtattaatgtctatctgtgtctactttaccacacagacagatgataatttttcattgccttttatacacacatttatataatatttgtaaattatagagagacaacaaaatatttccttgttattttgtaaagctacggaagggatatttaaaggaaataaatgtgattaaatgtatccttgttgttgtggcgtcatttgaagccaaatgtgtctttgcagtaaatctaactgattttccactttcctggtaccattttaaaaataagccctatctctttttaaaataagtcttctattaactttgattccaaaaaattctactagaatgtgatttatcacatctattatatagagataactgaacaatatttatctccacataaacacaaaaccatttctagataagattaattcagagtaaatattctttccatgtaatttattgatatgttataatcctttaaaaagcctcgtgtatactctatgacaaatatgattcgcattataaaaatcttgctcatccatgccggcttaataaagggaagtacagttttgaaaacatgaccaaaaataattttgtcataaaatgtgcttgatgtttgtgtttgagaaaaaattttatgggaaaaaatatttactgccagctcaattgagagagataaactatctcccaatgagtgatatgatggttttgatcctatactgaatttagtaatcatctttatttccatactcactcttctgtctgatttttttccaacatagtatgcatgtttgacttaaatgaagtagaaatgcataattagttttgtctaatgtcttcacaaaagcccatgatatgatagtgttcctggaccaaactgaggattgggctgcttattcttgtggcccaataacgagatgcagatgaacgggaaaaggagagagtttttatttctgtaagtggttacagggagaagacctggaaattatccccagaccaactcaaaactataaagttttccagagcttatataccttctacgctgtatgtctacatgtaagtgtgtatccatctaaagacataaatgattaacttcttctgatctgtaactaagatctgattcctgaagacattcctctggagcctcagtaaatttactttatctaaatgggtccaggtgctgggatgattacccttatcttatctccggctaaatcatggagtttgggggagttccttcagatgcccagtaaacttgtttgtggagtcctggggagtttcttcagacccccaataaagcttttttaattctaaaagggtcctgttaagaattccttcattatcttgtcatgcttcaaggcccaggaaaggcctgggcaaaactcttggtgggcttttgttaccgtccagcctttgtttaagggcgctggctctatcagcttttaatatgtaactttaccactcagtcagtgctgaaacagttgttgtggaggcctgcattagtgagacctggcctgccacaatagttcatttacctcttcattgccgcaacatatatgtccacattaaaaatccaggactcaccctctttgggcaatatcatgtgataaaataaattgatatgacatacttcttgcaagatttctttttaatttaccttttagccagcatgataagcatgatgtagggtaaattaacactaaacttttgagtcagtaaggtagcctttctttttttaacttttattttaagttcaggggtacatgtgcaggtttgttatataggtaaacttgtgtcacgggggttggttgtacagattatttcatcacccagatattaggcctagtacccattaattatttttcctgatcctctccctcctcccaccctccaccttccgataagctccagtgtgtgttgttcccctctatgtgtccgtgtgttctcatcatttagctcccacctataagtgagaacatgcagtacttggttttctgttcctgcatcattttgctaaggataatggcctccaactccatccatgtccctgcaaaggacatgatctcattctttcttatggctacatagtattccatggtgtatatgtaccacattttcttggtccagtctatcattgacgggcatttgagttgattccacgtctttgctattgtaaatagtgctgcaatgaacatatgtatgcgtgtcttataatagaatgatttatatttctctgggtacatgcccagtaatgggattgctaggttgaatggtagttctgtttttagctctttgaggaatcactacactgacttccacaatggtttaactcatttactctcccaccaacagtgtataagtgttccattttctccgcagccccaccagcacgttattttttgataaagcaggcttcttcacactactctctaccttaggagaaaacgttatatccatactttaatttatttgaaaagaaaggtgaatataaaattgaaattctctgagtcttatttttcttatatgttcttgcctacttgtaacaaaacatataataaaagggcattataaatagtaaatcatataaacacaaaatattcccatttttgtcattatgtaatgtattttctgaattgaattgaaaaatgcatatatttatgaatttttttctactgaatctctccttcttatttacttctattcttttccatgatgttacctggtcttcttgagaacatgatattttaattgtaatcattgtgttcctaactccataatttcatgatgctattgaaatgcacatgaattttgattctataacctagtttgtaataagccatatttccttgtttctctacattggttgaatctgttcctgcagcaactagtaaccccaacaatctgactggtgagaaattcaatctccgtaacattttgcattcttctacttcttcccacttccattccaaagggccaggtagagtccagaatactgtaagtgtcctggttttcagtgcattttggtcatagctgatatgcttaatagccaagtaaacatgactacataaaggacagcttgtccacaatgccctgccttgcttgaacacggaaggttttgctgatgatgctctgtgcttggtatctggcctctacagccatttaagtaggttgtctcagcacaacatttggaaactctgtaaagggagtaggatgttggccttcacaacttcatccctttccctgtgtttgaggaagctcattaaacctctctttaatctgactgattgcaaatttccactgtccccgaatcttaactcccatatcccaatagcctgttcagttgggacaatatatcaatccttaacatgaatctagattttcagaactaaagtttttgaagggtgattttcctctggatacttgttcatttctttattgattatggttttggctaccttcttggcatcaaacagggaaaacagagcatttattcatgtgttactatcctattacactctgtatgccaattcatgtcctcaacacgtacacacaaacacacacacgcgcgtgcgcgcacacacacacacacatacatatacacacacccagtaaacatattctatatttaaaatgagcttagaagtttttaaaaaaggatgatactgggacaaagtggcaaaacattatttcagtgaaggaggtaacaatatatatgtacctttccattgtgtaagtgaattctaaatctgtatatagctaacacatttatatataactattgtgcaatgtgcctgctttaacagaagtaatcgagcagagctattgtgccatggaaggttttacatagatctaaaatggctcctgtgcccctggcttcctgtttgtttttatctgataataggaagaattaaatcattagagcagatgacgtacagtgaactatgtctctggatgctgatgagcagcctgcacaagactttggtaacaattgaattatttagtgcaattattttggagagatgaatattgatacaggaaacttacggaaatcctcgtttcagaaatagtgaggattgggaactttttgtttatgtataccatgatgttaataatcctactgaaaattatatgtatatggttagttgctccaataatcatatgatacaagtattcaagatgagtaaaatgtgaatttatgtggcttgctcacagtaaataggagagatgaagctaggacccaagaaaatggactctaaaactcatgatatttccatacctattattgttgggacaaaaattccacctacccaataatgcatttttgggacaaatcatcaaattgataagtcctatgagaagcaggcaggggggttggagacagtgaagactcaataacaggtggtattaaatgctcgcttactcacagaggatttaatctacctttgaatgtttagtaaccccaaaatgcaaccattgtttaggaagttttttagttgattctttctgaatgatttctaatacaaatgcccctcaacttgtgtggttaggtccctataaacccatcataagttgaaaatatcacaagtcaaaaatgcctttaatatacctaaccttcgaaacaacatagcttagcctaccctactttaaatgtgctggcttaacactatcctagagctgggcaaaatcatttcacacaaacctattttataataaagctagctcatgtaattgattgaatactgtactgaaagtgaaaaacagaatgcatgtatgggtactcaaaatacggtttctactaaatgagtatcaccttacactattataaggtcaaaatatcttaagtcgagaactgtttgtactttaaatgttaatattttttacatactgcgttttggtgagtgaagtaaacttagtttgcagtagagttatctaaagtgatattgtcattttcaaacattgctttttatttctactactcataaacaaattattgtgtttacatgattatttgaatattaacttaaaacagttttatacgaaattcaaaataccactttactggcatgtgaactccctaacatctacacttggtgttaagatgacttgtcgaatgatgtgtttgtgtttggaatcaagatgattatactaaatggtttaatctactgagaaccattcccttgaatgttttcctgaaacaatctttgcaaagtacctaagtaacaaaggatattactcagttagtgagacaaaaatggattgtgataggtctcactgttttcaaagaaagacaaatcacttattgttaatagtaaagaagtttcttagaaatatgttgctgtttatcaacccagtgttactgagatcttgacaattccttttagaaggtaaatgttttggtctctaggttatcatgtcctgatacaagaaaattggaattattgattacacctatattctctggagtggtctcagtgccaagcatatttagcttgcatatgtaaatatttaccaattagcatgatagttgctagcaaaaaaaccaattctttatggctgatgggcctatccattatttatctgattttattttgctttctagcaaaacaacatacatggacattagtgaagcatttttatttagaaaagaacaattgacactctggtaccatcctatcagagatatatgtttactaaaataacctttcaacatttaacaaatacttattgaatgccagctatgtgctaatcatactgtcatacagtgatgaaggcataacccaacatggttttccctctccaagagattatcatctgagaaaggaaacaattgcatcaacaaataattaaaataaaacataatctttaatgcaatagaaatgctgtgggaacatagaagacagaatgactaattgcttggagaggataatagctttttaaaatatggtgacatttagtctggtgttgtctacgcagagacaatttcaagaaagatgaaggcagaaggaattgcatgtagaaatgtgtaataatcaaagaagtatgacttgtcaggtgagtagtagcaagggagatctttaggagtgaagaagagaggttgtgagagggcatataatgccattcttgaagaattatattgttgtggggctggttgagccaacaataagataatggcttagtcatgttaatttgcaacttctgattgaagactgtgaagctctaaaacaacaggcaatgatagaagaattagactgccccaccaccactaatgcttcatgcaaaatttggtctgaagtctaccctttacatttggcaatagacatagagacctaaaatggaaaagcaagcaggctaccatttttgtagagttgtttgataccatgcacactccaaaacgatgcagcaaaacgcattggaattacctagaaaatgtgttaaaacatggattgctgaggcccatagtcagagtttctaattccataggtctagggtgggacccaggaatccggatttctaacaggtcctcaggtgatgctgatgctgacggccaaagaaccacactttgagaaccacagtgttagaatttcagtaatttaatcaggtctgtagtagagaatgttggaggaaaccccactgaggaatttattgaaccctcaaaggggaatgacctttttccagttgagaatcaatgcaagtacttgatttaaattgggatttattttgtggggactatactcaaaaactgaatgagttaaaagactcaaaatcaatcaatctgatactgattgagcattcttcgtccaaaacgtttgaaaatagaaatgtttcaaattttggattttcgtttggaatatttgcattatacttactggctgagcatctcaagtccaaaaatctgaaatccagaatgctccaatgagcatttcctttgtgtgtcatgtcagccctcaaaaggtttctgatttgggagcattttggatttgggatttttggatttgagaggctcaacctatacctattttttaaaaaatgtgtatatatatatatatggatatacatacacacatatatatgtacatatatacatatttatacacatatatgtacatatatacatatttacacacatatatgtacatatacacacatatttgtacatatatacacacatatgtacatatatacacacatatgtacatatacacacacatatgcatatatacatacacaaatatatgcatatatacatatacacacatgtatatatacacgtatatatacatatatacacacatgtgcacatatgtgcatatacatgtatatatacacatgtgcacatttgtgtatatatacacgtatatatacacatgtgtatatacacatgtacacacatatgtgtatatacacatacatacgtgtatatacacacatgtgtatacacacatatgtgtatatacacatacacacgtgtatatacacacatgtgtatacacacatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatacgtatacacacatatgtgcatatacacatatacgtatacacatatacacgtatacacacatatgtgtatatacacatacacacatacacacatatgtgtatatacacatacacacatacacacatatgtgtatatacacatacacacatacacacatatgtgtatatacacatacacacatacacacatatgtgtatatacacatatacatatacacacatgtgtatacacatacacacatatgtgtatacacatacatacatatgtgtatacacatacatatacacacatgtgtatatacacatatacacacatatatacacgtgtatatacacatatacacatatacacacatgtgtatatacacgtgtatatacacatatacacatatacacacatgtgtatatacacatatacacacatacacatatgtgtatatatacacacatacacatatatgcacatgtgtatatatacacatatatgcacatatgtgtatatatacacatatatacatatatacgtatatatacacatatatatacatatatacgtatatatacacatatatatacatatatacgtatatatacacatatatatacatatatacgtatatatacacatatatgtatatgtgtgtatgcatatagacacatatacatatatacacacatgtgtatatatacgtgtgtatgtgtgtatatatacacacgtatatatacataagtgtatatacacatatgtatatatacgtatatatacgtgtgtatatatacatgtatatatacatatatgagtatgtgtatatatacacgtatatatacatatatgagtatgtgtatatatacacgtatacatatatgtgtatatatatacgtatacatttatgtgtatatatacgtatatatacgtatatatagttgttttaggttataagacttaaaaatacttatctgatgtatatatatatttttaacaatcctagttattttgtgtttcagggcagataggtgatgaataaagatattaatataattgtgttcaaaggttagaaaaaaacagttcgttgtggcattactattgactgtatccgcaaatttctttcactgcaatcctttcatgggctactatatatttttcttaagaataaaacatttccaattgacctacagagtctttcaatctctcttttgtgctttactttgcttcagcagaaggatttcattttagtgacactctgaaggtcttcctctgtgcttcacttaagggtgttgcatttttaaccttaccaagattcctatggattcctagaattatatttcaaattatgatcatggtagccagaacacaaagaattaagatctactctgacagtaatgtactgatataactttaactgtagaaacctttcttgtaatgcacatggagggcagacttgtatgtatcttggaacataaaaggcagagtatggtttttaaaagggctttgcttatttgtatcctaatttagctaatttcactatgccagttctatatgcagagataagtaatagtaaaaatggacaaaaagtgatcaataaacaagtgatcactttcggtcttgtccagaattgtggccaggtgatgagtgcaaactaagagaccttttcattagaaatgtgtgaagttactctttggtttagcattagctgtcttttaatgagaacaaatgagagttgcagatgaatttgctaaatgtttctttctttgatttagtttacctggcctgaagaaaaaaaaatgtcttcgatctacaaggtctacggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcagagtgactgaggaagagcggtaggatctgcaagtggagtggtattagaaggacaaatcagatagggccttattgaccattgtaaaggtcttggcttgtacattgtgggagattaggagattttgagagttctgaacagtagccagaaataatgtaagttagaatgtaggatgtaaaggtagaagtagagagatgagttagaggataatgtagtaatgaaggctgggtgtgtgcgtgtggctaggattaggttgatgtccatggatctggggagaaatgatcgaattttggatacattttgaaagtagatgtaacaggatttgctggtggactaaaaatggagattgagagagtggagaaaaacagttttagcttgagcaaaaggaaggatgggatggttatttactgggataagaaagactattgcaagagagagtttggtggcaaagtataggtaaatttcccatggaaaatcattgaaaataattttagttttagtatgtttttatggaaggagtatttattttcaactcctaaaatttatcctcaagaacaagaataaatacatttatctctattaaaaaataaggaacaatgagagatgatacaagtgcctctagcattgtatgagtgtgtacaaccagtgaacgttaacttgtaaatccagtagcagtaacttgatctttgtctctcttctgatctgatagagtgcaaggtctatgtctacattcatttttttgcatgtagatgtccagttgtttcagcattatttgttgaaaaggctatctttgctccattctattgccattgctcgtttgtcaaagatcagtaaactgtattcatgtgggtctatttccacactattctgttctattgatgtatttgtctattattttgccaatacactgtcttgattactgtcatttcatagtaagtcttgtagtcagatagtgtcagttttccaactttgttcttctccttcaatattgtgtgggttattctgggtcttttgcctttcatataaactttagaaacggtttgtctatataaggcaaggtaacttgctgtgattttgattgggattgcgttaaatctgtagatcaacttgaggagaactgacttctttacaatattgagtctttctatccatgaacactgaatatttcaccattcatttagttcctctgataactttcatcagagttttgtagttttcttgtaaagatcttgtatattttttagatttattcctcagtattttatttttgaaaatgttagtggaaatggctttgtgttttacatttcaaattccacttgttcactgctggtgtgtaagaaacaattgaattttatatattaatcttgtgtcctgcaactttgctacaattgcttattatttccagggttatttttcgattctttcagattttctacatagatggtcatgtcatctatgaagaaatacagcttcatttctacattccaatagatatgtctattttctttgtcttattgcattagctaggacttccaatatgatgttgaaaaagagtggtaagagagacatttttgtcttgttcctgatcttcctgagaaagttttcattttctcaccactaaataggatgtcaattataggtgtttttgttcatttttttatattgtcatgaccttgttttataaaatacaattatttctctcctaactttctgtggacctcaattataattttcccataattctcttctgcttgcattgctcatgttttctgtcttcttcccatttgttcttatttgctttattttgaggaactgtttctcattattgaagtcattcctcaaattacaagtgatcttagcttttggtttatatttaagtgtgagatactaacatttgataaaattaaaatctatttcatgattaaagtacatttaatataaaacagaattgaataattttgttgacatattatatatatatatgcgtgtgtgtgtgtgtgtgtgtttgtgtgtgtgtaaagtccaaaagtttgtacattacttaaagaagaaacatctgatgcattctggataaagacaggaaaaccatatgagtactacagctacctccattaatacttaacattgtgttgaaaatattagccattgcaaccagacaagataaaccaattcgaggcaaaacaattgcaagcagtggtaatgggatcccaatttacagatagaattgtttacctcaagagatcacacaaaacaataatattaacaaacacaaatatgaacacaaacaaataccaataaaataatttagtaagttagcagactataaaatttacaggcaaaatcagtaaaattcattttataggtaatgagctagaagtttttatggatggtgcacacccatttgcaacaatagcaacaacagcaaaaacaagaaacacatttaacaagaaatttcagtacctatgtttaaaactctcctgaacaacccaaaaggaaatcaaggagaaagatgctccttgttcctgaaaagcatggcttaacattataaagtaaactattgtttttaagttaatgtgtaaattaaaggcattccaatataataagtagtatttttttctggagttggataaattgattataaactttttataaaaaaatacacaagtaaaaataaccagaaaaacactaaaaataaatatcgatgaagggatagggaaacataaaattataaattaaaacttagggaaaactatcatattaaatataaattttcaataaaaactaacaatttgttaaaatgtgttttgtaaaaatatatttctatcagctgggaaggtctggtagtaatgagtatacctagcatgcagatattcattggtaagtctcattccacactgaaagaagtcacagctcattagaagaatatatgatacttcatcctggccaaggaacatagtgggtgagcctgcagcctttgttagagccataaggcaaggaagtacttcccaaaatttgctaacatcttgagttgttcatttttcttctcctgttttctttatgcttgtagagttacacctttttaaaaggttttcttcctgtcattttattggaaaggcttcaaataatttttaaaacatatttatagatgttcatactcatatattttcctgatactgaaagagaaatttatgcatttagtaacaataaatgttggcctagattttctctgatggtctcttcaagaatctggagcgttctctatctccacaaaggatggaaatgtttcatttcaatatgccagttttcaagtaaatgtgatttagtttctctcttttaagaataaagtcatagcagaatgctttatattactgattgtagtatcataacttacttctgaaacatcgaatacaattttggaaggtcagcaatgtcctgttaatatttaagtatgcctcactatataatatgtgcatacattctggaagaagcatttaaaatgaagactgtttctaataatatattaaacgagctatgtaagtagagttttatgatagctgatattgtgattttattcagagactatttatataagacatttcagcatatctgctaaagaacaaacctatcatctaagtcagtaaaccaataatttgaattaaaaaaacggacaaaaagaaaatacgaagcaacttgaaagatcattaaatacactgcctgatagttaagattctaaacagttacattatatgaatagtttactgtatattatatattttctatttccactttgttataggtaagctaatcagatgtctcaagttataaaataatagcactaacttataaaagaagtgctacctttcttccactccccaaaatacacaagattttattcttcataaatgataacatttgttgtttgttttctgtggttgaaagggaagtacaggaatgaaataatgtattttgcaacaacttggatagaactggaggccattattctaagtaaagtaattcaggaatggaaaaccaaacaccgtatgttctcactcataagtgggagctcaactatgaggatgcaaaggcataagaatgatataatggactctagggactcagagcagggggaagggtaggagatgggtgagagataaaagcctacatattgggtacggtgtatacttctcaggtgatgggtgcaccaaaatctcggaaatcaccactaaagaacttacccaggtaaccaaaaaccacctgttcccccaaaagtattaaaataaaaaaatttaaaattttgaaaaattaggaaaaggaagtacattttcatgtgttgctctgttttagcacacctggtgcagaggtccctgaggaattttttctttttcttttttcttttttcttcttctttttttttttttttttttttttttcgagaaaaaaatatcacacatttgaggcaggagaatagggtctggaggaagggaacctaaggccatttcacgctgacttccctaggactaaactgaaggcaaaaccctaactttccacccctaagtaacataaggaccagaggctactccctttgcaaacctcccaccttttctgtgtagcagatgggaaattggctgttcccaaccaatcagactgattgcgggcccagtctttgcacagaagtgcaactttgtaacttcaccttagcctctgattggttgctttttgcaaccaatcagatgtttgcacaggagagtgtcctatgtaactctacttcagcctctgattggttgctttccacaaccaatcagaccaattgcaggccaccacttcatttacgtggggtgagcatgaagtggccaatgggaaacctgtagagggtatttggaccccagaagattttctttatctgggcacttgagccgctgctcagcccgctctcacactatggcatgtacttttcattttaaataaatcccttcattccttccttgctttgtttgtgcattttgtccaattctttgatcaagacaccaagaacctgggcaccctccactagtgacacactgataagatcttattatattgggctgataattcacctacacttttaccttctgaatagaaaaggcacttgattagagatgtatatatctaggtgctgggatcaactatgccatttgcaaagtaccttacttcttgagcaagaaggtaaccaaaaggggaatgaataggcaatataatttcttttaaaaatgaattagtaagctcttgtggttacaacaagaggactgttgttttggttctttcacaattttctatagtaaaatttgttagtattaaagtataatgttgatgcctatatttttaaaagatataaaagtagagattttaaaagagaattaaaaaggttttgagggaactgttttagattaagtaagataatgaagagaaacaatgcttaaaatattagaaaaaaagacttatgagaaaagtcagaagtactgaaactgtctagccaaagtagaaacgaaaccaaatgatacctttctcattcatattaattatttgaatgctttggttttgtttttctttattttatattctgttagacgctgtctttcttgtcttcaaccaattcttttctatgtaacattagacagtgtctaataataatacacaaaacaaaaaagttgtaaagaaaccacccacattttctcttcaaaagaaaaaattgtctgagaactctgaatgtctaaagtccttgaataataatgggaaatggaggatggttcatgagtgtttttcagtattagcaaaagactgacaaaagcatgagtttatcaacaggaagtacatatagtcagacttatagactgaaactgttcctaaagctgtgtgtccctgttttagaactatcaccacagtcactgaagccctgggcaattcacagacattgcaaaatcaccacagtccctgaaggccaaagaatgagacacaggagtcttttatcatttcataactcagtgtgcccattcttcctaataggcaggacccagcatctgtggtcctcaatacaaccatttagaaagtcacattgtagtcactccttttgcttgttctggcagggactgaagttggagcacaaaaaatcttgtaaaattcagttcctatatcagggtgtttccccctttttatcatgaagtcacatgtcccatcctgtgtcttaacagtaggtgattattagaagagtagctggcacacagtagatttataataaacaatggaataattagagtgcctagcgcacagtaaatttataataaaaaatatagaataattaatgatgaagaaatgaatggtagatgtagtagaatagaaagatatataggaatcctgagaagtttggcagcacatccaatagaaatgtattgcaaaaagtttatatagtatttacatttcttatagcctcatttaaaaactgagaagaaacaggtgaagtaattttaataatatttatttaactatatgtaaaacaaaaatattatttcttcaacaggtaatcactatatcaattagtattatttattgcattatttattgtaccacctctctaaattccgttgtgaattttacacttccagcaaatctcagcaacacgggatagccactattcaggtgctccaaagccacatgtggctagtggctaccacattacacagcatagctatagaggggtcttagaatattctgactaagtcaggaagggacttttgtcacctccaccaacatcccatgggtcagaacccagttatatggctaaacttaattgcaaaggaaactagaaaatgtaactatagaggaatctttaagaaactattggtcagacaacctaagtgtaatgtgacaggatattatctaaaatcttaatttgaaacaattacatatagttgatataaaatgcataaaatagagaaggatgtactatttttgaagccaggttcaaagtgtatataatgaacactattgaacaaagcaagatttaaaaaaaattgtgaattgaataaaatatgtatagtaaatgtacactctattatgtaaactaaagtatgtttagtataaaaacacccctatactaaaactcctttcaatactccaaagcagtaagaaaaaaaacacaaaatatacatttaccaatcttaatagtctagcttataaactgatatggaattcgttacatgatccctgtttgaacattatgtaagactagcccaggaaatgatatggaaaaaggaatgaaaggtaactttcaacgaagttacatgggagagtgatcaaaagaaaatgtgactttttttccttaactcaacacgtgtacgtgacgcttcaagtatgcaacaatggatctgtgctcaagtcaaatgcacagaccagaaacagaaattggtcagaagacatttcttgttttttcggttttttttttgttttttgtttttgtttttgtttttgtttttgagatggagtctcgctctgtcacccaggctggagtgcagtggcacactcttggctcactgcaacctccgactccctagttcaagcgattctcctgcctcagcctcctgagtagctgggactacaggcacgtgccaccacacccggctaatttttgtatttttagtagaggcggggtttcaccatgttagccaggatggctcaatctcctgacctcgtgatctgcccgcctcagcctcccaaagtgctgagattctgcgttggtcatcaatgtttaaacatgttaaacgtaacatgttacatttaagtaacaatacctacataatcatgtaagtacattcattgccaacttaaaagggagtcttcaaagcagaattgtcagaacttttagcttccctgggccacactgggagaattgtcttgggccacacattaaatacagtaacactaatgatagatgatgagctaaaaaaaataaatctaaaaaatatctcatgatgtttcaagaaagtttacaaatttgtgttgggctgcattcaaagctgtcctgggcctcatgcagcctgtaggctgcgggttggacaagcttgcttcaaagctaacattttttctccaaaattttccctactgctatcgcgatcaatttgtttcctctgaagtgactgattttaactgagatatttttgtttgtttgttttctggttctgcatgtataaatccttcgaatagtgtaaggacactgaatttccagcaacttctgtttcgaaggttcacacttcaaactataacatgttgtgtaattattggaaaagtgtcctaaagcttccattattagcctataaactatagttttggaagagactttgcccaccattttacattactagctgtgagtgcctaacatttagtaagtacccaagaaatatgaatgttagaataaagtcatacatataagaaattctttacattgttcaactactggagaatatgttatatgtagtgattatttttaaaagcattataaaaagcatttcaatttgttcaagcatctcaataagttagttaaaatacacagaaaatgaataaaacaattagaatatatatgtagcatttgtgtgtgtgtgtgtatataaacatatatatgcaaatgtgtgtgtgtgtgtatatatatatataaataggtagagaactttaaagtaattaaaatctgaatgtggttagctcaagtcaggtaaatttgagaaaatctttacaaaagccatttgctcatactactcactctcagattagttgttcatcaggtaaacaatttgctaaataaacatttaaataaaagaaacacattgcataggggaagaaaacataattttacctctaccttgattttttttttttttttttttttttttgacactgggtctcactttgtggcccaggctggagtgtggtaatgcaatcttgtctcactatagcttcaacctcccgggtttgagccatccttccacctcagcctccccggtagcttagctacaggcatgcaccaccatgccgggctaatttattattttttttactttttggagaaatgagggtcttgctatgttgccaaggctggtcttgaatgcttgagctcaagtgatccttcagtctcagcctcccaaagagctgggattacaggtgtgagccaccgcatctagcctctacctttatttcttaactgggactcctataacaaaagagatatcaacaagaaaaaaacaataaagtttactaacatacacacctcatgtatacatgaaagatatataaggaaaaatgaataaatttctctgacaaagaacaatacgttttttgagaagtaacaagacaagggaaaaggaccctgagtctctatgagtggccaatttcaggaaggcaaatatatgggaaactgatggtagataaaggctagttaagaaaatttattatgtagattcctctgatgcagtctccgggctgataaagatctaaagttgtcattggtgatcaaactttgtcctttctgatagagaggagaggatggacacctttgcaaatgtatgtactgttttcaggcaaatagtgggagggcagagaacttatatctgcttcttctgaattgcctttagctcaaaatagtcctgtgtcaaagtggcatattttcatgaacatagagaatggaataatagacattggagacttcaaaaggtgagaggggccgggtgcggtggctcacgcctataaccccagaactttgggaggctgaggcaggcagatcacgaggtcaggagttcgagaccagcctgaccaacatggttaaaccctgtctctactaaaaatacaaaaatcagtcgggcatggtggcgcgtgcctgtaatcccagctattcaggagaccgaggcaggagaattgattgaacccaggaggcggaggttgcagtgagccgagatcgcgccactgcactccagcctgggtgcacagggcgagactccatctcaaaaaaaaaaaaaatggcgggaggctctcatgtaccccagaaatttatacacctacagtgtacccacaaaaattaaaaatacaaaattttttaaaaggtgagattgtggcaggggagtgaggagtgagaaattacctattaggtacaatgtacactattggagtgatggtttcactagaagaccagacatcactactatccaacatatgcatgtaacaaaactacactgtacctcctaaatctataaaaataacaacagaaaaaggcaaatatacatatgctttcttatagattcattaatctgttttatttcagtgaatgaaaacttttgacaatggctaaccttgaaaatatgttattagaacatgtttttctttctccattgtgccctatgagcacaacttgagaaatccagcaataaaatgcaagctagtttttttttttttttgaaacagtcttgctctgtcgcccaaggtggagtgcaatggcactatctcggctcactgcaaccttcacctccagggttcaagcgattctcctgcctcggcctcccaggtagctgggactacaggtgtgtgccaccatgcctggctaattttttatttttggtagaggttttgccatgttggcccggctggtctcgaactcctgacctcaggtgacccgcccgcctctgcctcccaaagtgctgggattacaggcatgagccaccgcggccatcaagcctgctttcttgacatattttgtgacatattttgggatggcatatttcggtctcctacagttggcagggcaatctaaagtactttaatatccttcttcatgatactttcaaaaaatggaatttgatgcctcagaaaacaatactaaaactttcttaaaatattacaatgtgtactatattacttttttaagtaataggacttataaatatttatttttaaaatttgtaaatatttaccatccacctttgattgaacatttttttctcattattttatccaaaaatgtctattgagacctttaaaatttgtattttgtggcaccatctaagacgtgatttatgctccttgtcattatttaatcgtcaaaatgatactttgtctttgcttaaatcagtgtgggtacatcgaacaaggtttgagagctactctgtaggactgagtcattagcctgtaattttacagcggatcaagtactacgttttcattacttggaaagaaaatgaccttgcaattgactcttacatttaacgtttttatctcagctttaccaccattaaatataactgtttgcactgaccacataagaaaccagaaaaatcactgggtcacagtttaatctaattcaatttaaatccgagctagatagctataattggcagtttaccatatcaaaggccagagttaagttacactcaaaattgtgttgatttggaagtaatttgccttaaattttcaagcattgttctgggggtactaaaatgctctttcaagagtttactatatggtacgtaatattttccaagtgttagatgatttatgaagtctacattattatctaaaacaaccaatgttgtaactaccatacaagtctatgaatagaccttatttcacttggcctatctcagggtacaggatcccagccttcttccgtggcaatatgcaggctgttcctcagcaacgatttctagtattgtgtgaaataatcatacttacaatactaacttcttgcttcccaatgccaagaacactcatcttgtttctattgaataaggtgacaggcatgatagaagcagggcagagccaagtcctgacagtaacatttcaagtacagagaaattcatatgagaaaaatggacaatgagggcttgttgtccgtgactttttgttccatgaaaaatatgcctgttagcaaaatcacataactaggaattttagataaagtttctatgtacattatttaaaagagtgctttatacggcatttaagttaaaaagaaagaaaaaacattcacattaaacctaaaagtaactaaaaagtcatagaacagagatgtcatacagatggctagcctttattaagtgtcaagcattgttataatggatttgcatgagttctttaattgcatttatttatcttgttttggtttggtttttgagacaagatctcacttcgtcactcaggttggagtgcagtggagtcattgcggctcattgcagccttgacctccaagccatcctcctacctgaacccccaagtagctgggactacaggtgtcccccaccatgctcagctaatgttcctattttttgtagagatgggggtcccctatgttgcccaggctggtctcagactccatagctcaggtgatctacctgctttagcctctcaaagtgctggcgtgagccacggtgactgaccttatttatttatttttaatgaacaagtaacagttgagtaatttatggtgtacaatgtgatattttaatctatgaatatattacagaaacattcaatcaagctaattaacatatctatcacctcactaacttatgttttgtggtcagaatgttgtctactcttggtgggaatgtaaattagtatggtcattttggaaaataatatggagattcctcaaaaacctaaaaatggaattaccatatgatccaactttcctacttctggatatatatccaaaggtattttaattgatttgtcaaagatatatgtgcactctcagttaattcttaaagcaacgtactgagatagacattattagtatcctcattttacatatgacagaaccaaagcagagaatagttaaataacttgttcaaggctaaacggagaaagaatcaggattctttttaatattttcaagattcccaagttcaaatgattaaacaatctattttttttttttttttaaattgggggcttccaccttttttatatttgttgttagtgggatttaggacatatcatccccaaatatggcaccttggcatttcgggaaacagcggaagtgagaaagtctctgaccttctgccaccattttcctctgaagcagatcagaaaagaattatctggccttgctctgaagtaggccataagacccctcatgtgtcccatacctaaaggaaaggaatgtcacactgggacacagagaagactgaacaaacaggctttgctacattcccccccaccccaactttattaccattagattacacccttttgttctccaatcatacttctgccaggttgtccactcttcatcaaatttagcataaaaatacacaggtctcccctttttctttaggtattcatttctgaatgctcctgtgtcctggtatcatttgtaaaatttatattaaatacatttgtatgcttttctcttgttaacctttcttttgctataggggtctcagctatgaaccttgtgataggcgaggaaatcaattttttctcccctacattgttcacaatccaatttaagagaaaaagtgagcactcttgatgatccagtaccccccaaaacacacagacacatgcagaaataaaacaaaagttttataaaaggtggcatttttagtatatgtagccacactttaataattttatttcattcttttctatttgtttttttttttcctttttttgagatggagtctctgttgctcaggctggagtgcagtggcatgatatcagctcactgcaacctctgcctcctgggttcaagcaattctcctgccacagcctcccaagtagctgggactacaggcacacaccaccatgcctggctaattattgtattttagtagagacggggtttcaccgtgttgcccaggctggtcttgaactcctgaggtcaggcagtccgcccgcctcagcctcccaaagtgctaggattacaggcatgagcgaccgcaccagccttctatttgattttttacattaatggcagttatgacacataaacgggttgtacagctcacaaatgtcttgacctatagcttgaagagcatttgtctaaatgacttgctcaaactacttactcacaaatccgggttctaaagttaggttttttggtttaaaaactgtaggctttttcctcttggttttataattgtgtcagtccaaaaattcttcatttcctaacttttctccatattagctataaatcagaatagttgggaactaaatgggagctttgccaaaggggcaatccccaactacaatgcgttggtctaatattcagtaaaatacattgattttagtaaaattcactgcatattttgcattttactcaaattcaatataaaatagacagtttttttttttttttttttttgagacagagcttggcttttgttgcccaggctggagtgcaatggcgtggtcttggctcactgcaacctctgcctcctgggttcaagcgattgtccttcctcagcctcccaagtagttgggattacaggcacctgccaccatgcccagctaatttttgtattttagtagagacggggtttcaccatgttgaccaggctggtcttgaactcatgacctcaggtgatccgcccccatcggcctcccaaaatactgagattaccccacctggccaacagtctgttcttaaagaaagaaaattaaaataaatataattactagattcagtgtacattttacttttgtgagtatcattcaggaattcttacctcagaaaacctggaaaaggcaagttatttagaaatatgaagaaatcagggtgttttattcttaatgaaagcatgcatcttaatttatctttagaaatgactgggggaagttgattatacaatcaaaatgattaaaattaggcatgtagactttagtgcaagcaaatctgggccactcatttccaggtacatgaggaaatgtactagcacttcttttattactatagctttgaaggcagcgtgttgtcttacttcccattgtttggatttttaaactgataattaaattcatttgcatcactgctgcttggattacaaatacttaaaacaattagttttctgtcagatcacagatctacatcaaatagatgttactttttaaagaataagccctcaccaattagaatgattcaaaagcttttgattgttttctccaaattgttaagtatgcatttgtctttaatgtaaataaatagacttaatggcataaaaagccattctgaattttaaatgaatgacaaaatgtaaatcatgttctggcataatagttttgccaaagtttcaagaaaagaaataggagcattcacaataagcaattgcaagctgtgaaatggcatattaaaacagaggattaagttatttttctagttagtttttggggaaaaaatctccagtcttgcagaaatggctaaataattgcatttggtatggaggctacttttggtcaaaattatgttaataaatatctgagttcctcacattaaagtgaagcaagaatctgtggcatttttttaagtcataaaacatttgtatgttggcttttagatagtaacaagatggcatccatttatctgtatgcttctgcgcatacaaccttatatgacatatgtaccaataaaaaaagtatacatgtattagtaattaaattctagacttgtgctgtccaatttggtagccattagacaatggcaaaaaattattttgaatttaaattagtgaaagtaaaagaaactatgttgttcctccattttgctagctacatttgaagtgctcagtagtcacatggttttagtggccatcgtgttatgtagtgcatgtatagaacattttttgttttttatcaccaccaaaaattctaatggacaatgctggtttagctcttcagtattgcaaactttagcctttaaaagctatttgcaattatttagcgtgtattgtttatgctccaaaatactttcatctcaatgtagaaagaaaacgattgcacttttgaatataagagaaatcaaatccttgatttttttctacataaaaacgtggaatttaaactgaattatttaacaaaaatcaaagtaccttagaaataacctgaaaagaaaaacaaattttagataatatatataattttgaagtagaagaaaactaagataaaacgtactgcatttgtatacttttatagttttctaattattattataattggaaaaaatgaattttaacaaattaggtataattatcactgtggtaagcagtctccagaatggtcccaaattaaggttgtctgattacggaataccatgttcttttaagtccagtaatcccaaccttttctaggataaagcttggtatatggaatcaagatatgtattcttgttattcttctgttaccattactgctgtgggtttcaagaacaggcacatacagtttctccttgtgtgacacaaaccttgtgtgaatactttttggtacgctttcaaactggggcagcactagatgaatgccttttccctaggtatgcctttcagtaaactctccaggtgagaggggtgtagtaagtactgctttacatggatctaagtgacatgatttgatcacagttcaggtggttgtagttatgaaccatttcatgttaaattaaggtttaggggtttattttctaaaataatgctacttacagtgacagcatagcatagaatctacaagttctaaagcaactcaataacttctcttaaatggcccttattattttggattagcattttggatgacaactaactccactccctctcttgaagggaaagagatttggtagaaataattgaatgaatcctggattaatctagaatatgattttatcaatgactgatgaattacactgcactcagttgataacggtgtcttcttctcttagaaatgttgagtttgttcctattattatttcaggagacaaagctttttaaaagagttggtcaactgtagctaggcatgaaagcatggtctctaagaagacacttataattccctaagtatttgattaaaaggaaaacaagtacctcaaaaactcttaagtttatgttataggcaaagaagtccccaaacaatttagtcaacactctgaaataaactcttaagagtggtgattttcacttggcattttggagattccatgtgtggcaatgtgctcctcaatcaaggagttacatttctatgtgcagtaacattgcagttgcacaattaatacaaaaacaaacatatattaatcaatgacaggttttctcattttcatacagagttatgaaacctttaggctaaggaacagaatagtgagaaattagacaactattaataataggattaattagattctggccctacagctaagaaaatggagtgacaatcagaataacaccaaagttttgcaagttgtccaagtgacaaaatacaactaattaatactaataaactaaagtcaaattggactctatttacacaaagtactttttatatacaggcaaaaatttaagtagaaaaattatggcctcccagaactaataccaaaaatttaatggtaagaaaatgaacgtattcatttaatatataaccacatcatttgaaaatattgagctctcattgtaaagacatgacattttctctaaaattaatatattccataaaaatagtttttaaaagagaaaggctttgtcttcattcttttcgtgtgaaggtcaaatatcttagattggaatttaactgcaggaattatgcttctgttcttactttagcaacactaacgatgacattttctgaagtacatattgttaacaccatcatgatgaaagcaaatcatttttctacacttactttgatgctaatcagagcagtcatttaagttgctacatgactctgagacagaaatttcaaaatgaaattgaccaccgattcccagacaaaaccagaatagtggtgtcagatgagaagggttttgcagtgttttgtcacatttcattttgatttttacttttttctctgtttgacatatgttctgaactagagtgccataaagttttatcaccataagtttgaaatgaccacattactcatgagctacagagtcacaagtgagtttttagcttctttcaaagctgtagaaataaaactttatagtaccctaccctggtatatgttgttttatgtgacacattttgttccactttattcttttcttttatttcccttcattattttctttttgaattatagcagaatttgtattaaatttttcctaatacacaacagtttaagctacattttataatatcttatgtatttttttcatacagattatctttgacctgtaatgcccatctcttaaagaaattttagatggtcattataaacaaggttcattgtgaaatatatttctgttgaaacactgattttattacaaaaaggtaatgtttgatttccatgagaaccaaaactattggttgagatatgaaagatgaacatttgcttccctttacacaattgattaaaattcttaatgcatacatagtcacactacacaattagtgtagtacatacatatccgtataacttgagtcttccatgtatatgttatgcaatagaacttctacaaagacatcaatatctcatgctgaaactatccaaactataaaatgattttaggattagcttatcccaaagggaaattgtgagcaatgtggctggcctgacagcctgaagtgatatgctcagagtggatctgataggcagccattcatttcaagctcaggaagcaaacttattattttgtcatacacggtcgtttttccattgaagacattaagacggtaaagaaagtcctcagagtctatggaaaggatcaccagactttcattttatctccagatcttgaactggagcttttgaagattccattttagtgatttctggaaggctgctaatcttaatgaataaagtcagaaacacatgtgtgtggctgattcagattccagaaagaattttggttgctatcatgattatttttaaggcataagtgattaacgctgagatatactgcttttcctatttgtggattaaatttcttctatcggagaagttctaattgaaatgtctccattcaatgtggttgtgcacacacacaagtacacccatgaatgatattttacatatgtaaaaaaagaaaaccgatattaagtaacttctacttttcattatgagacatgctgtgtgtgattttatatatatatatacacatatatatgtatatatgattttcctgtgttttgttaatcattttttatcattttataatttttaccattttcatcattttttattgtgtggctgatatatactagatattactcactcagggaggatacaccctcatctgggcactcttttatacaagttatggcttttgttttaaataattcatctaagtttaatgaaagaaataagtgactgctttatcctagagaagcagcaaagagattttgttcacctgtgcctttagagactacatgacagcctctacaagtagcagggtagaatcaggttgattataaaagccttcatttcatgctaaatggaaaggagaaaagaaagaattttctcctttaattagaatgtggcagtttaatgacagaggcactattgttgtgggttaacatggaatgaaatcaattaaataggactatgtatacttaggtgtctgtaggaatcaccaaaaatgtaactctccaacagtttgctgaatctgcctctgttttgtctggctgctatacttggtatgtgggccatctggctcctggattccagtaaggtttgcatattcacacatcaatcagaagtggtgtagggcctattaggaagcaccagccagttaggtgacatgccaggactgcaaagcactcaagcaggaatgccaagtggggagcttctgctgaagctgacgctgacacgggcattggaggcaccttttgatccgtctagctttactgttgatgtcacagtcctgctagatcaggcatagggatgtcaggtcacgtaaggcctcatttatgtcattggttttgcctggataattcaaatggagcaaaaataaaagtgatcttgatccttaggtcccatgacttttgatagtagaaggatcattgatctgaaattgtcttgcattcctgactagtagacagaaagatatcagaagcaactttgtctattctgtttctagaactatattgtgggtactagtttttcacagtagtactagacatttcagaaacagctaccgaataatctttccaaataaagggaaaggttgtaataaaatgcattcccattccctatgtcttctcaaacagttcactgaaacttaaagggatgagcacactttacaagaaatgcaaataaccttttagttcactgaaataagataaacaacacatgtgtgtatttttaattggaagctctatcattcagttccttgaactaacagctactatacttttcttttgatgtatgcttcacagatatccattgcaagttttagattgtttgcttcaatgtagataagacaaattaactgaaaacttaaaaagcacctagaggattggttattttaatgttttttagacctctggatgctttgatcccatacagaataggatgaaattccactataatggcattgttttaaaatttgaattggccgtaatgtgttgtgtgtgcacacatttatctagctatgaacacaattaatactcactgagagagctctttaaaatgatgacataatttttttctttgaaaagttatttcttacgccctaaatttctaaagtcaccaaaaaaaggtaattttctatatgtaagacttatttatagtaactaaatttctaagtaactgatatctcctaaacagaaatgtctaataacttacttctagatcagctttaacaatggttttgatttatctaacttagtgcagtaatacaaatattagtagtaaaataatacaagtttaactaacttggtataataataggaataatataattgctcatgtttgatgtatgctaactacttggcaccattaagtacatcacatgtattatttcacttttctcattaaaatagcagtgtgatgctattatctccattttacagagagggaaagtgaggcatggagagaagtcgcaatttagaaaagtaataagtataatacttattttaattttaaattattctttgctagaggaaagatgcatgttccttggacatcttctatactttaataatattatttctatgtttctagcaacccccacaatgaaaagcaaatacacgatgcctttgggggacaaagcagttctgtagtcaggcccacacatgaagtgttttacctttataggtttcaacaattaattggaataagctattttttctgttttggcatctgtctacttggcaaggcccccaactgtggtgttggcagctgcatgacagcgactgcctctggtttttccacagcaactggctgaaactcgcctccctgggctgtcctattatgttgaaaattattttctttgactcaaatcagaagagtgtaatagaaattgtgaaaattcctgacatcttcccaaagatgtttttgaaataggttaaggttctccgggagtaaacttggattctaaatatgattttttttttctgacagatgtatgcatgtgttatggtaggtattcagaaatgaatgctctcatttgtaaaataaaataaaataatcccaaactcttaactatagcaatttgtggttttaatcgttttcccttgtaaatggaaacttggtaagttttagagtgcattgtacatgataaaatacatcttatgtctaaaatcttagaaaatattatcttgcattggggaaaacatcataatagtgcatatgtgattcattttatgtaaagtcctaaaattatctaaattaaaatatctatattctatagctgtgcatgtgtgtatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagtgctaggagaaaaggtgatacaaacactacttaaaaggtttccagcgagaagcagctctgaacaaagtagatttaaagtgttacctccttactcctacaaattctaatgggaatcaattatgttccatgagtaataataataattaatatttatggaagtgcttactatatgcttggctctgaaataagggcttcacatattatagcacataactatcctaagtagaagatactatttttacttccctttttatagatagggaaagtaaaacacagaggtgggccgggcacggtggctcactcctacaatcccagcactttgggcggccaaagcgggtggatcacctgaggtcaagagtttgagaccagcctggccaacatgacaaaaccctgtctctactaaaaatacaaaaattagccgggtgtggtggtgggtgcctgtaatcccagctacttgggaggctgaggcaggagaatcgcttgaacctgggaggcggaagttgcagtgagccgagatggcgccattgcgctccagcctggggaacaggaaggaaactccatctcaaataagtaaataaataaatagcacagaggttaaataactctcctacactcacacactccatgtgtctctggtgatcacttggtaccacttcttttcttgcatgtctcacctctcttataaacacattaccaattttaaatgggtgttatgaactatgtgtattaattatggctgagaaccaccatttttaataacatggaattttctttagctggcagggaaggaatgcttccagtttaaaaaaaacggtaaaggacatagctttaaacagaaaagacgctttgaagataagttcatgtccataaagtccattcaaataacttagtaaattgctgataaggtcatatcatgtagcattttttaaaaataagattgctgaaagttcagcttgctctgagtaaacacagagcaagatgattctcaattatatagtgaataaaatcaataagaacatctagtgaaatccaaacagaaaataaaaaaatcaaaattgacttttaaaaaaattgacattttatggagataattgtagatacatatacagttaataagaaataatacggatatcctatgtacactttaccattttttccctaaagttaatattttgcaaaactataatataatatcacagccagaatattgacattactacaattcagcaattttattcagtttctctcggtgttcctatatgtgtgtgtgtgtgtgtgtgtgtgtgtgtgtgtgtgtgtgtgtgtgtatttagttctgtacagtttcatcacatgtgcaggtgtaggggaattggatatcacctccaatcccccttttagttcttagtaggctcttcagttggatctagaaaccaaatcgacatcaggcagaaaacaaaagaaaagaatacaaattgtattacttatacatgtacgtggagatcatcacaagaaagtgaagcctgaagaagtagtcaaagcaagatgcttttaatgatgaatgatgaatttgatgaatttggaaagcaatgacaggataaagagaatctggctagggacagtaaattttctctaggggagtcactaggagatagatagtgggtataaaactagtgaaagataagggttacttcagtaaatatatttattcaggtccattgaagcctccaattctaagtctctggtaataagggctattttctcactctggtcctgtgagggtgcccctcccagaggaatctttatggtttgctgcatgtaggaagagacaggtgagctaactctttctgaaactacaatttctccaaagtttccaactgaaaatagccaacataccaatctggcatatttggggatggaacatcctttactccttcacaggtatctgtggatgagagctgaagcaggcccaccaggaacagagagtgtttccccttactgttggcaattctctggattgcatctacccatcctgtcctagaaagtgtcaggagaacctgatgttgtctcagggaatcctcttagatgtggagagataagcctttctaggctgctttcgactgctggttgtgggtctcgaaatggtgagtctgggtcacttgcttctattaagtgaaaagatgtaagtcactcaacttctgctccagacccagtaaaccaaaactccgtcgtcttcttctgactaccttcagagttatcttgggtttattcctgcattattaccagcatttgttgctgttttagtgggaagaggaagggaaaaatgggtcgaagttatcttacccttaccagaagttcctaaatagactttttcatgagaaagaatatttttaaaaaactgtttatattataaatattcttggtagtttttttgctgttacatattttttaaaaatccatagtgcagatataataaaaactattgcaggtatttaaattaacagaactagttgaattcctacaacgtgtcatgtacagtgctaggttggttgatctgtctgtgcttctgctttacttggaatggatgagcaaaggcttatactaatttgcacttagtattataatgaggtgtgagaaaccaattttcatattcaagtgtctataaaaagtgactatttttcaacagttagctcctttaattataaaatcagtttttattaaaggcagttgatgctttgtgtgttgttgctagggtgacatatattatagaaacatacagtttatctttccagtaagagggaatacagtctctatcttaccgttaatactttaattagagaatgatcgacagaaaaatcttttttctcttcatgagatttgaaaaatgcatatcttctttatctgcatttaatcaaccctgggttcattaggatttgttgtgttggcacctgagaacatcttagaaattattaaataattcattttctgctttttttctttattttttatttccagcagaggcttgtattaaggagattctcttttgacatacccccacatacattcacactaatatatatgcactattttcaactgacatgttttagagttattgagatattaattttataggatactatcacattttatagctcttagtaaatagtatggtatttcaaaacataatttagttatagtaatagaaataatccatcatatttgttgtatttataaaatgtcttcaaaaatatcatataaatgatatctgaaattttgtcctagtcttgcaaatgctaggggattaatattaataaggttgttgtcaatataaatttctagtgagatgctcattaactggaaatccagtgctagagagacatttcagaatacctaaaccttatttagagacaaataaacatactagttaatatggctattgctatgaaccgcataaaattgaaatttgcccgaactcattcagctaagcatgctaacctcggctttggaaaagattgaatggcctatcatcagtcaatcttggtactagagttaaaagaagaggcaagtaatatggacagcacaaggaaaatgacagaaatagcggcttgtgatgataattagcaagaagtttgaataagcaaactctaaagaatattgaaaatgagacaaaaactgttaatgtatatgcaattaaatctttggaccctccttgcttgttgtttcaaatatccaattgtggagagaactacgctagggtaataatattgcccgttttccctgtccctccatgtactccaattaagaaagcagaaatgaaccatctaccctgatttttggaggaggaattgagtaggtatggcttcatgctctttaaattggggttaagcccccatgatataaattatatagggaatgcttcttcttccatttaatgcttactaatggatgtcactaggcaaattattagcaaacatacataataagaagacttaatgctatgttcgctgataacagctttatcattagtaaaggagatattttcatctctattcgtctgactcctatatgtgcggcttaattgattacgaacctaggtggggaatagatttaataattttctcaaactccatctataagtaatatgaagacatgataaatttttaagcagaaaaatgaaatgaaaaatattatgattcggaaaatttgtttccttgtactatgaaggatacttgggagcaggttggagaagagggtgaaggaaccgtttgggggacgcgtcagtaaaactggtggtagagactaggctgaaggatgatagtgggaatggaaaagtgaagacatttgaagggaagaagacattgtgtcggagttctaacgatgttcatttgtgcataaaacttgcatttgtctatcttattgtactttatatattcttcctaataccctgtactccattttactcctttttttttttttttttttttttttgagacagagtctggctctgtcgcccaagcaggagtggtgcagtggcgcgatctcggttcactgcaacctccgcctcctgggttcaagcattcctcgcgcctcagcctcccgagtagctgggattacaggcgcctgctactacaccagcctaatttttctgtttttagtagagacggagtttcaccacgttggccaggctggtctcaaactcctgacctcaagtgatctgcccgcctcggcctcccaaagtgctgggattacaggcgtgaaccacctcgcctggcccctgtaccccattttcaatatggcaaatggaataaatgtttttacaacatttatttgactgttgtttataactcttcaatagctgtccattactgtaaagtttatgccacaacctatagggctctaccttttaacagctatctctttctgattttccacttctctccaacctccctccctaaattacggtgatactgattttcttttaaaatacaggactactatcagcctcctttttcatcttttaggccacaacttaatgtttcttcctcagagaaatttctaaaggacccaaacccacaatagcttctatatgagactacttctcccattatatatcttccaggtatcctgtaatctcctttacaacagccagcagaattgaagtacactatttgtcaaccaaaggtgtgaagcttcttcttactcctggtgtttgtggttttattgactcttctttgttttctttaccagtgagatcccatctacatctttcagtattttcaccagtatcttggtcttttgcttgcttgctttcttgttttctaggttgattataattttattcctctaaacacatgaataccttccgtcattccaatggaattttggacaaaagggaaaaagttataagtgccaatttggttgccatgaaccaaaacagaaaattaaatacaattgcctagataatcaggcccaatttgtattacctagtatgaaaaacactttggtaacaacagtaggtcatgttaaactaattaatttctaggaacattgataaattaaacattggttactctccagagtaactctaagcccagaaaataagtgacttgtacatccatcatctgattcaggttcaaagagagtttctttattttggcaaagccaactttactgaaatgagatgagaagatttctgttgccaatttataatggagattaaaaataagaccccattgtcagagttggagatcatatgttggtaattgtggttttgtacaaaattaagaattgatccctaagaacttgtaaattataaagactttgtttagctcagtcacatttgcctaatctaagatttctgtctaggagaaataattttctagatggagtcaactagtacacctagtttaagtcttctttatgtgagattgtgtttaaaacagtgactcttttggccatagttacaatgagttcttcaagggttgtgtatttgcagactatcagtggaaagcacttgaatggcaatagttggaaattttgaagcaaaggaaataaaattgttacttgaaaccttgtaaaaagatcatacggccgggcgcagtgtctcatgcctgtaatcccagcactttgggaggcccagacaggtggatcatttgaggtcaggagttggagaccaacctggccaacatggtgaaacccgtctctactaaaaatataaaaattagttcagtgtaatggcgcacgcctgtaatcccagctactcaggaggctgaggtgggggaatcacttgagcctgggaggcggaggttgcatcgagccgagattgcaccactgcactccaatctgggtgagagagtgagaccctgtctcaaaaaaaaagataaatttttaaaaatccatgcaaagagcttgctattttgctattttagggagggagcatgagcttcatactcacttggaatttcctgagataaaggcagaaatagaattggaaaatatttaatataaatctgaaaagataaggcatttctcttagaagaagtttctaagcaaggcagctatatagcaaagggtgaggtatatatccctggctgcctcttagcacagggaactggcaccacggggcctacactggcccaagagttcttcaaagataattgtgttcccacaacttttctctgtgtagtaaactcttcctgccctgtagcagtccgcccagttcatgaaaaccatgggatttgacccactgaagaagacttttctcttaaagtttttcctgtttatccaggttttacccagtaaaggtcagctataactggtaatagttttgtcaatgtttccataccttgggacaaagttccttatttgctcggtatttcctctcaagttttacttggcattttgaaatttgaaaaaaattctatgtttttcctggctgtgaaaatgtattttttctttagtatttgatattcaatttataaaataagacttaaagcagctagatatttgcccatcgttatgtttagtggaatgaagaactaatcagctactactagtcttgttccaattaacattctattcctccatttccttcccacactgatatatgtacatatatagatatcagtgtgatatatatatatatcacacatacatatgctcatatatacatatatatcttatataagtctttgacctttctaagggtcaaacaccatgtttttcacaatctaggcaagctgctacaaggaaggaagagtctattatacacagaaaagctgcaggagcacaattatctttgacaatacaccttatattggtattttattttttttctgaaattactctgggttgagtcttatatttagtttctaattgtgaaggaaagccctgtaatgacctggtgatccatcttctttagaaccaagtcggccacagtcctaaaataaacatctgaaggcataggaacatttacagatgaaaatcataatttaatcaattgggtgtattatcttattttctaaatatgtatacattatttctttttttcttttttgtgagatggagtcttgctctgtcactcaggctggagtgcagtggcatgatctcggctcaatgcaacctccgcctcctgggttcaagcgattctcctgtctcaacctcctgagcagctgggactataggggtgtgccaccatgcccggttaatttttgtatttttattgtaacagtggagatggggttttgccacgttggccaggctggtctcaaactcctgacctcaagcgatccgccccaccttggactcccaatgtgttgggattacaggtgtgagccaccacgccaggctaccgtgtttcttttaaaaactttttttcttctatgtaccgtataggttttaaccctgtaagactgaacaccctcttttgtaagacatattttgtaatactcccattactatcctcaaagagaatttaccaaaaatgtaacttacatatatatataaaattctaaaacaattaccttgtaaaaaataaatcaaaggacaataatgaattaaaaataatggatatatttatcatcaataattaattattcaatatgaaaataagaaaggtacatactgctctagataaatgtagtacctgtacctaaaaccacagaagtagacagctcgaaatgctgacgtatgcaggtgagtggtatgaatgattaaaatgccatgaacagcatattttaaagtaatgggatttttctgtatgattaataacatttggtaaagttctgaataaaataagtgcacattttccctttgatttattgtgggatagtttcattcttggaaaatgcagtgcatataaagactttgtatttatatgtaaaattgagctaggttctatatattcacatacttataaacaggctgtcccctacttttcaaaagctgaataggacatgaaacaattactcattttcctggactttcctgcgtgttactggatgtctggcgtccttagagcacctttccatccgttatggggacaatcacagtgctttcacgtttcttaaatgtacccagggtatggtggtgtgcccagttgagaggaactgcaagtgagggttgtatttttttttttttgagacgagtctcgttctattaccaaagctggagtgcagaggcgcgatctcaattcactgcaacctccgcctcccagcttcaagcgattctcctgcctcagcctcccgagtagctgggattacaggcttgcgccaccacacccagctaatttttgtatttttagtagagatggggtttcaccatgttggccagactggtcacaaacttctgacctcaaatgatccacctacctcggcctcccaaagtgctaggattacaagcatgagccaccgtgccaggccagggattgcatttttgcatcgaagtagcagaaactagaaccagaggattttaactttctcatatgatggaatctgaaggaatggagtctaaagcaagaaactggccctgtgatggcatgaaaatcccaggcccctttgatcttcttgctcttttacaccttactatcattctcatgcttgtcaactcttggttgcaagatgatggtttcaacatctccagcctcaagtcttacatttcagagcagaaagatgaaaaaggaagcaagaagaaggaagaggcagcatgtacatcaggaaaacaaaactatcccagaaatccctagctgtcgtcctctcagatgccaaaaggccatgactgggtgccagagatgcttgaaatagagctctttgttcttgcttgacaccttgctacttctaaacaaaatcacgattttgttgttgagagaaaaaggactcctccctatctacttgtcctgagactgcttcagcctctcagcttcctagaccctcatgcagttgatttccaattcttccaggagctggcttactgtctactttttcagggtttcaaaaaaaaaaaaaaaaaaaaaaagcattttttaaagtttaaaaagcaaaatgtggagtgaatattttttggttactatgctttttaaatttttagaatttgtttttactgtgggttggctgttaatagtccatcaagacaactatttctttgctgggtttattggatattgggcaagcaaacaagcaaatagcagtatctgccactggatgtaatcaggaagaaattttcagaaaaaaaaaatgatgcttcaaggtctagataagcagattttccactggttcctgattattctaaataaaatgtttagtcagtggttgtgtaagtttcaaggatgttatagatggctcttgaaaacaataacacattaacctaatattttcagtactcctttttctagcttcatttatcctctcccatgcctgtaaacatgttactttgttaaccaaataaagtcattaatacatgagaccattttgccaaaagtaaacttaaaattaggaggaattggtctttcagaaggcaagaagagaccaagatgaaaggaagtcatttttgtgaaccatatgttttgacccagaagaactatttcacagcctttctcctggtagcaaacaatgagggaaacagtttcttaccatctgcacaataaaacttgttgaatcactcgggaattgggattattgctactgtttgtttgttgttaagccttaaatttaaaaaaagacaggatatataagcagggttggttctaatactgaaataaaacaaaaatgaacaaacccagagaaatctgcttccaaaaagccacagcacaacaaaaagaggtgtaaacatcagaagacctcaagggaaaaatacgtttatttagaaatgggatatcctggggattttgttacagcagctttattaagatattattcacatactgtaaaattcactctctagaagtgtacaattcagtgttttttcagtatgttcacagagctatgcaactatcatcactatctagttgcagaatactttcatcatccccaaaagaaactgtatgcccattagcagtcactccccattcctctctccctctagcctctggcaaccgctactctgtgttgtgtctctatagatctgcctattttggacatttcatataaatggaatcatactatatgtggcctctagtgtctgtaatctttcattttgcataatgtttttaaggtccattcatattgtagaatgtatcagtctttcattccttttatttgctaaataaaatttcattgtatggatataccaaattttgtttgtccatttatcaccagtttacgggtattcgtaaggcttttttttcccactttttgcttccagtagactttttgtatgtcacaaatggccatatgtttctttatcccataatcagaataaaaattatcattcttttagtggacgtgcctttttttaatcaaggcacagaaataaaaaagtgagttgtattttctcattaagaaaacattttggggtgtgcatgttttcagttgtttggaaatatgtagacatattggcagggtatcccacttacttttgctgtgtataaaatcaccctgatacttagcagtttaaaacaattactttattatgccgtggatgctgtgagtaataaattcagataggacacagcagggatgttctgtttatgctctgcaatatctatagcctcatctgtcaagacttgaaagctaagttggactcaatggctggagggtggaattctgaaggcctacatgtgaacttgctatgttgtttggcttcttcctagcatggtggctttacgatactcacacattttctatggtaactcagggttccaagcaaacgctgttctagcaaacaaggtagtagtcatatggtcttttatgaccctgccatggagggcacaaaacattactcttgccatcctctatctgttgaagtagttacaaactcacccagattgaagaggaaaggacatagaccctacctttccatttgccaatgagttttgggaccatattttaaaaccattgtgccataaagggcatgttttatgacaggtgaagctttacgtcttaaaagtatataattacaaatgattaaatttaaaatcacgagaataaaccattgcattcatctaccatcttgccactaaatcagaatcagtaaaacaaggtcaaattgactagaagccacatatagttgacatttggaagaatttgacagaaatatggctcaattggagttactgaatttaaaccaaaacgtttggcaccaagaatcatgggagcccagactaaagaggaaacatacattatatagctcttattatctaatggtgaaaatcctatcaaatctccacaaaggtggtgaactctggtcttccatggcatcctagacaaactttatttacaggcatgtatggtatataaaataggcatagataataaatataataatccagaacaatgataaaacagctactatgtcaaggtaccatcctaacctcacttataatcaggcattaaattctcataagaatcctatgaattagacaccattattatccatatttaacatatggaaagaaactaaagtacggagatgctaatgaacttacccatcgtcccactaataaatgttaaagtcaggatttgaacctagatgctcaggctccaaagcctatgctcaaaactcttgctatgtgaatactggcatattactgaataaaatagccccagttttgtttttaaataaaaaatgttgatcaatttttttcaataaaatattgtttcatcacaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaattctataaagttaaatatatatggatgtgtgcacacatatatatatatgtgtgtgtctctaggtcatgaatcttttaatactatagaacatagaacatagaaaattataagagaaattaaaatatattgtcaatttaaaagcataccgaaaacatgttatatgagaatggaataatacaaattattggtatggggagaagaatcatgaatagtttcatgaggaatgtggcatgtgtaacaggcattaaatatgattaagaactaacactgagtatatacaagttagctgtatcaataaaaatgtaaatcattcagcaataaactataaagttatttttactccataagggtttttttccctgaaattttcggcccaaagtgactgttttttcttcacatgccacttatatagtgtgaccaagtatttagttaaaaaaattattctccagtcaaatcatttgttgtacacttcttggagctgtggcttgcttgtgtttttattgattaaaaaatacagcacaatcttgcacctaataaaaacctaacaaactggctgagtgcggtggctcacgcttgtaatcccagcactttgggaggccaaggcaagcggatgactggaagtcaagagttcaagaccagcctggccaacatggtgaaaccccatctctactaaaaatacaaaaattagcctgacctggtggcaggcatctgtaatcccagctactcaggaggctgaggcaggagaatcacttgaacccgggaggcagaggttgccatgagccgaaattgcgccactgcactccagcctgggcaacaagagtgaacctctgtctcaaaaaggaaaaaacaacaacaataacagaagaaacccagtaaataataggaaaaaagtgaatatagaaaagtaatagaaaatggttgcctttgtgaggttagatgtaaccaaaatattttagcaattgtttagaacaaatagattaaatgaaaaatatttccattaatattttaaactgttaaattctgtctaatttcacatggtagatacacattcattaagacttttcagtgttaagactaaataaagaaaaagaaaattcttcttattgtgccttattcagaatccactgaatttcgttattatttttattatcattatcattatcattatcagtattatttgagatggagtctcgctctgtcacccaggctggagtgcagtggcgccatcttggctcactgcaacctccgcctcccgggttcaagcgattctcctgcctcagcctcctggggagctaggattacaggtgtgcgccaccatgtccagctaatttttgtatttttagtatcttatttttgtgggtacacaatagatatatatatttatggggtacatgagatgttttgatacagacatgcaatgtgaaataatcacatcatggagaatgggatatacacccctcaagcatttatccttcatgttacaagcaatccaattacactcttttagttatttttaaatttacaattaagttattattgactatacttaccctgttgtgctatcaaataggtcttattctttagcaaagcatatttgtaaagagtttggagtttctctttgctttacacactgtaaaaaaaaatgtcaaacaaggttatccaaagagtagtaggagaatgagcattgagatcataagtgtctcatctgatcaaagttattcaagaatgaatgcattttggaggcaagagttgaggaccatcgccatcattgactatggagtaacacaagcccagactcttgagattaatttggcattatctttcaaaattaaaagtataattacatatttacatagcaattctacttcaaggagtttgcccttcatttatgttttcacatgagtaagggtttagatggacatgggttttctttgtagctaggtaatagtaaaataggtaatctaaatggacatagcttggtggtagtccatgcctgtgccctttatactacagttttaaacaagagatgaatttatataaacagatgttgaaatgtgatcgttatgtagtattaattgcacaaaagtagaacatatatatgtgcatatgtatgcatacatacatgtacatacatatgtgcatatgtgttctagtttattatatatatgtcaaattgttctatttgtatgaaaacactataaatacatacataataaataaacaaatatgcgtttgtgccaaaaagcacagaacatttctgtttagtctcataccactcattttatagctttatagataggaagaaggtagactttgatggtacttgaatttttatctatgtatctgggcaagtattttatctatgtatgtggtagcatattttatctatgtatgtggtacatacatgttttatgtatatgtatgtatacatgcatatatgtatgtataaaatacatacatattttatctatgtatgtggtagcacgtgagagaatttttgttaatttatatgttatttcacttcaaaaattgataaactgtgtgtgtgtacatatatgggtggtggctatatacatatagatattatatttctgggtggtttataaagagcagaaatgtgttgctcctagttctagaggctggtgagtccaaaagtcaccagcatgttaggtgtcttgtgagcccgcttcctcagtgacgttcatcttgttgatgattcctcacatggtggaggggaaagggagcgttctaggttctttttttttttttttttttttttttttttgagacagaatctcattctgtctcccaggctggagggcagtggcacgatcttggctcactgcaacctctgcctccgggtttcaagcaattctctgcctcagcctcccaagtagctgggattataggcacccaccaccacgcctggctaattttttgtatttttagtagaggtggggtttcaccattttggccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattttactattttcaaagcttttgttcactttgtatatatgcatttatttatctttgtagcaaatgaaggataaaaatatcttttggagtattatcttgacatactctccagctgctagggatgacctgtcagtattgaccccttgggctgaagcaattcgatcctctcaaaactcaaattgaagtgagaactatctcttctcctttatttcctttcaccagaaatagctatttcatgttttaaaacaactggaaggtaactgaaaactttcagtggtgttaaatcactgtcagaaaaaaaaaaaaaatctgtttgaaagttggaaacagctcaagtaaagccatttaatctgaccagcataagcagattctgaagaaaatggtgaagaatatcattagcagcaatgcacacagtcatttattcattcaacagatgaacatttgatgaacacttactggttcttggggactatactccatgcctaaaatacaaagatgaacgaagacccaattcttgctctcaagaaaatgatagtctgttaagaagaatttactggaagatagataagtataatactgaaaagtgtgaagaatgaaacaataagatgtgcaaagtacagtgctgtcacaaaagagagagaaataaaagctaactggacaggtcagaagaggcttcacatggcactgtcttgaagaatgcatagaaatattctacaaccagcaacttccaattcagttgaactatctccatgcttcctgttcaaccgagattacattttcaatcttgtttctaaaggaaggaaaaaaagatgagtcatttggtacaaaaaagcaagaacagctatagtctacactataagataaatgtagggtactctttaaatctagtggacgctgtccgtaccctttcagcgctcccattttgtctcatcatctaattgcgtgcacctgaagactttctctgatgggtttgccactgcggggaaggctagaagtgctggaatattgaagacccaagcagcattcttcaggttaataatagatgagaattggatgataaaaactctaaactttttacactcaaataggatgcatgaggcatgtctatttcatttgctagaagtctccagtggcattaagtcccagtcatccatagtcataacttgctcattaatgtactctgtgtgttcctttcttctctatctcacttctctacttcctgttgatgctttctgtgatctccatcacagatcttcctgtttctcacttcctgttgatgctttctgtgatctccatcataatcagctacatggactcaaatttgtcatttaagtctgatcttggggaatccaattttagacattgagcaatggactggctgggagggatgaaagaggagacaaaggggctcctatgttcctggttcaggaaacggatgaataacatcaccagttagtgaataggcactgcctttcagtacctacgggagtgctttgttcagtacatatcctgcccagccaagcactgaagaattcatgaattttattgtaacctaaactgcctgtggcattatgaacctgtgtaatcatgggtagtgttggctttataccaggattttgctagcttgttagcatctccatgtgcatttgcaagaccttggccactcttcagtgttttctactccaatttgcatcattgtccctgcaggatgtttatcactcagacattctgaaatttggactgatgcttgacttagctctgtgattggatgcttctcccagaacctttctcacctctatcagctacgctaatgataatctagacagaggtttccctccacgggtgctgcagctcaaactgtgccctagaccactgtcagtcaacctcttcaatgccactgtttggtgctttgcttggttctttcagtctgcatgaagtcgcagctactcaacttacatccatgaagcagcaaggggaaacttcccattctcagtgttttaatctgttctctgttataaaggaggcatagtagagttgctggaccccaaagagtgacttgtaataaaataattctttaaaatgtatacatagatcttgtatcccagggcacacatttgacatgaaaatggctgttttggttgtaagtgcaggtaacagccatcaaggtgtacttgggactcctcctccactccaaatcttaggcctcattattatttagtttatcctgtctgtatctgcaagatgatttttacgtgagaacactagacttaccccttgacactgtgctttttgcagctcctcatatttgatgggcatgaaagctaatatgttgtctaattatggagagttttaagttattaattttatttttatcaggagatccttaaccccctatacaaattagatctaaatagatactaaaagatgaagttaatatttaactcctttacccaccagatgtagctgaatctttgcattggacaagtgagaatcctacttactctgaatcttagatactttgctttgagtatgattcaatgtcactgttgctacagaagtataaatgatggttatttatgcttgcatgttttccagaaagttaaagactattttattatattggctttctgattacttgactgaagttcataaactaacaaataaaaatctaaaaacactctctggggacctagacaaactataatgattaaagcatatagttactttgaagccaagatgaggtaaaggggataacttaagacatatttattcttaggctgacatatcttgtcattattatgttacaggtgcacatggaccatttattttttctcttatgaagaatttcaaacatatacaaaataaaaaagtaacataatgcataccatacactgctcattagctctaaccattattatcattaccatctggtttcctctctacctacccacttcctattctctgttttgaggcaaatccccgaaagtatatcacttctactctaaacatttcagactgtattcccaagtaacccccccaccccacttcttttttttttttttttgagacagagtctcgctctgtcacccaggctggagtgcagtggcacgatcttggctcactgcaacctccgcctcccaggttcaaatgattctcctgcctcagcctcccgagtagctgctactacaggcatgcgccaccacacccggataatttttttgtatttttagtacagatgggatttcaccatgttggtcaggctggtcttgaactcctgacctcaaatgatccgcccaccttggcccctcaaagtgctgagattacaggcgtgagccaccgcacccagccccggaaaatatttgcttaatatcatcaaatacattttatatttcccaaattatcctataggactcctctcttctctctgttgtctctgtttcctccacaccctacatcctcctcctccctcatcctcgttctcactctcccttttcatttttgaagaaacaggaccttttgtctaggtttgttgattacatccacatgatattgtttaatgtgtttcaccagctcctgtggtgctgacaaattagcagctaagtctagagagctacttgtagtcagtttgattttgttctttttttactcaagatgattgtatagaaagtgttgtgtactttcaacaaaaggtatataacgtttgatattggcagccattgatgatcattgttttgattgattatttcattatgagttgcaaaacaatgatatactgtttttacttcttcatttgttaggaggagcagttctataaagagaactttttgttttgttttgattttttgtttttgagacagagtcttgctctgtcacccaggctggagtgcagtggcataatctcggctcactgcaacctctgcctcccaggttcaagcaattctcctgcctcagcctccctagtagctgggattacaggcgcacgccaccacgcccggctaatttttgtatttttagtagagatgggattctgccatgttggccaggctggtctcaaactcctgacctcaggtgatccacccacctttgctttccaaagtgctgggattacaggtgtgagtcactgagcccggcttataaagagaactctgcatttctatttggttgcctcatagtataattgatacaaagcaaagcagagtaaatgcttcagtttttcccccaaaagaacaattttcaaaataatgaattgcttctctagtctcttccaaaagttgccagtgaattttttttttttttttttttgagatggagtcttgctctgtcaccaggctggagtgcagcagcgtgatcttggctcacttgcaacctccacctctcaggttcaagggattctcctgcctcatcctcccgaatagctgggactacagacgcgcaccaccacgcccagctaatttttgtatttttagtagagacggggtttcaccatgatgttggccaggacggtctcgatctcttgacctcgtgatctgcccacctcagcctcccaaagtgctgggattacaggcgtgagccaccgcacccgaccaccagtgaatattttatttatttattatcatccagttgtttgttttggcatcactgcgaatgcatgaatttaaatatatttaaatgtaactgaggctctccaccttctgtattatgatctttattgtcctcatatttttcatctttatgcgatggaagcctcctttacattgacctcctgagtcctttctgtatgacctttatacactttggttgaccccaacttctcttgtagatcaccagtgggcattcctgaggtgtgggtataacatttatctctggattatttattcattcagaaactttacttagtaattaacatttactaggcgttaacaaggaagcagtaaagcagcaaacatgctcatttcaatatttggattaatacaatcaatcaaaacagtagttattgacaacttacttattgtgtggttagcacactcaaaatttatgcagagaaaaaagatgagagattagacctcctccttactgtaacacattttcaatctgaccagagattttgcttctgcaaatttggatgcctagcattggcatcatcaagactttcatagctatggaaccatcagatataaaatacaccttagtatgcaacctcaacgtgttcttcctcttgcaattgaggttatattaatttattaagttcattttgggataaagaagacagaatcatagttctttcagcctgttattataacactttattatcctttacctccttccaatttttgtgtctaataattcgtgtgcatgtgaactgtcttcacttttgagttttattatgaaactcaaactacaatacacatgtatgcataaatttctgtatatgtggcatgcgtgtatatgtgtgtatgtatgtgaatatataaatttcgttgaatagagtggtatgattgtctttggcctccttaattatatatattagcatatgttctagggctcctgacgcttcttgcaggcagaaggcatttccagaggttgtgtagatccatgaaggacagttatcgggtcacatctcacatcatcactgtttctttcttgcccctgtcttacactagtacccttcagggtattgtatgaaagcttcattggttcaaattcattttgtcctctagtgctactttctatgctgacaaaagcatagtgaaactgatgccctggcttgtactgcagtaatattgcctccaagcatatcaagtacaggaagttaaatcctatatattattaagccagatcagtaacatgtacccaacaatgtggtgagacatattttgttttaataaaacgatgatgttacaaattcttcaaccttcccatatgtgtggaggtgtgtgtgaatgtctgtattaatctaccccatgtctcctggatagagtttttctacaaagaaccaagctcagcttcccctagtgttaagacattttgcttcatgcttggtatagtgtagtgctactcaaacctgagtaataaacaggccagtttaaagaaataaaaagccctatgctcaaccaatgctgattaaaattatttttattaaaatttacctatagaagcacgaatataaaacaaagggcacactctttatggtgaaagggcatatagatctacaacaacaaatcatattttcaaatcaaataaaacagaagtacagaaaagcaatagaactcaaaagcataaccttaatgtgtctgccaatgttgtcttggatacattaaatggccttttataatgtgaatatagtactagctgcaatggtgcaagttattgtatttttagcatttttcaatatatgttgtgaagactattttactgcttttctctattcagatctttgcaaaaaaactcatgtatacactataatcatgttttttgccattttgtagtcctatgcttttgtgtcatcagccttccccagctagaaaagtataatattctattattgtatgctgttgtcattttcccacaatcaaaagtacaaattattaaggaaactgaagtttcggtctaaaatgtgttgttcagatgaaattatccataagaaattaaagttgtgttcttataactggaaaaagaacttaacgcaagtataatatgtgcaaaactgggatgacttagttcttgctatcattaagaggggacaaatggcaacgagacgagctttaacagctgagaaaatcttatgcctagatgtacataggcctggaaattacatagcagtaaaactgtaccttcaaatagctcaaaagcagctcataataactgcttgagattatctcagtgataaagtcagtataacatagtgttttttattttaaaaaggaaaaatgattactttctttacagtatgctaattaaaatatacaggtgattgaaaaaactattaataaaaatcagtaattttgttgagtgggattatgaatattaattatttaattaaaatttccttcaatagttaacaaagatttattgagtttctgagtcaagcattcttctaaaggctctgccttattagaatttttaaatgtatttgcaatgagtgtatattaaatgtaaaatgtatgattcaggtttaaaaaaaaatagcagtgagagtaattgaatgctgaggttaaatagaatgggtgaatcaaccataccataaaaaacttctaagtggatattatattccaggcactctttcctacttcagctgttgataaaatcaaatatttccttagagacccttgactaatgcaggaaataaatgaatacttgcctatatagacaaaataataacaacaaaagccagaaaccaagccataccaaaacgaaacaaaaacagaaaaactgtgatgacataacttatctttcaataggattttctcagaatgggaggcaatatatattttatgcttccatggtctgtagattccaacatttgtataattaacatatacaattttacaagggaaaaatactattcaacaaatacgtaaatacgttcaatgtaatcatgcagtacttcgtttaaattgaccttttttttttttttttttttttacaaatggtgcaataaaataatcatgtttaccttcttcacatgttcattgatgttggcgtgcacggttttatctatatgatgtgaccttttgagaccacatgacattcacaaactgaaactaaaccaactaaataaccagttatccaaagataagcaaaagtggacgtcagtttaattagtaaggggagattttaatcagtaatacactattataatagagaagagttcagcatgaactgaactgaactttgatttgtgtagaggtgactgggagttttaaagggagaatgagagaatgagtttgagtggtggctcattaaagtcagggaagtaacaaattacaaaaagtggaaaggtgggattgttccctgggaaacctctacgtttgctaaatggcacttaaggttaggctcctgccttctcactgtcttcgggttttgactggaacaaagggtaaattattttggcagctttgagttttctcagaaatgcaccttaagtggggctagagttatcctagagaggtggctttgacctgttagaagctatgttagtgttttttgttcaggtctgtgcaggccaaggttatggcctagctgagaagagggctcagaggagcctagctaaagtttggtcaaggggagcgtcttggtggagcctcactcctgttcaagtaaagaagacacattattcatccttctgaacagtgtaagtccatttgtcattcgattgccttttgtttactaaggactagctaaatcatcggttgagacttgctagtagagcatagttgctggatgatgcacgtgatcaggcatttaatgagaggcacctctatggaaacaaacataaaaacaaaaacttgttggagaagaatataaatcctatttgttgagtctagagggcaggcagttaagaagttttctagacattgaattctaagcatcttcagatggtagagtggtaatctgatggattttctggtttatggtttgaatgtggtgatggcataaacattaatttcacagtcatagttatttcctggaacagaacacggatgatgctggagttccagtggactttctgaatggctcttgtagcaggagctccaggcatgaaggttgcctatacgtgatttgttgtggtggtaagtcttttgaagtttatatcaagttcttgggcttcagtgtgcaaggctttttcaaatcctgggggagaaagacagctacaagacaaccttgtaggttgtcccagtagaatcagtaggttgtaggagtcccagtaaggatttgggcagtcagattttaattctcagtgatgtcaagtcaagagggaaggcaaaaaattataaacatcaatttggagagatgtagcccgatattgaaggaaaactaaacaattgagtatttagtaagagtggcaaaatgggtgagatggcagaattcagtttagtttacaggtaaatgataaaatcctcaagacaatgaacaaaattggaatctgataacccacagtggtgtgttttacataaaacacaacaaaaccggaattggatgagaagagtccctggatctagggtcatcagaatgtagctattaagagttggattctgaagccaaattcaaattaggtgccttgtactttgcgcactgaatgctctcaggcaaattatttaccttctttgtgcctcagtctattcatttacaaaaggaatcttaagagtatatatctcataggattgttttgaaaattaatgagtacgttacattcaactgtgtctgccacattgctgtgaagttattaccttcctaatatacttacaaacttcataattaagaaaaaataaaaattcataaaatgaacatatttgtaataacttattataaatattgtatagttcattaaatgtattacctttagacatattaaaaataacacacccctcatccccccccaaaaaattcctgtatgcctgttttaaagcagttctgcatgttaaagctgcatttatgatatctaagaagtgttttttctcctaaatagcaggttggtaataatgtatattgcaatcgtaataatgtaagttctggttacaatagtttatctgggtaacatgtagaagttaagtgaatgaggtaataaattaaccaataagattacctttctggtagggaggaaaaacacttctgggttgaattaatattttgtacacatatgaaaggaagaagaaaaataagaaataccatttgcaaagctgactttaataaattttaattgaatggataaacattttagttaaaggtagtaatcttaacttgagattacttgagataaaaatatatattttcttaagagacatgattgttagataacttagagatataataagtggaagggttttccattaaggtaactgatagtccttaggtaaattaaataatgggaggaacttgtgttaggaaatcaacatccgagttacagttaaattggtgggagtctttccagtgcctgaagatacagagattttcaatagaaataaggtttttctgagaaattaagtgaaataaaatgtgcaatagtgattgataagcactgtttattgaagaaacgatttatctttattcttgccctttgctttttaaaacttttattgcattttcttctatttttaatacactttgttattgaagcataacataaccatataccataaacacagatagctaccactcagatcaccacttggatcaagaattaggaacgaacatatttgattttaactgcagtctcttctctcttacgctgaaaatctatgtttctaatgacattagtataattgcttatatggtaattaccttactatatacatataatggttccaaaataacagttcttgaattatttttataaaacaaaattaacacaaagatttatagtgatttctgcatttattttattattatatgtttacagacattggctaatgcttctgatgatcaggcttctctcgattaactgaagatagccttactctgcagctgtgtatttcttattccatctggagcctatgccatcagacattatgtctgccatattttttcttctgtggaaaatcagttttctttctgaagtgcttatttttacctttggctgctgatgtagatctttcatttgttcttcatcttaggctgtgccctggctctaaaaagtgttctcactgtctctttgctttcatttttttcctttcctatccctacgcccttaaatcacaatatctgtcagagttccagaagaaagaataaatactcaaaggagtcatgactattataatagttgatagtgtttactttggcctagttgtttctagatttgtctcaagaagcaaacaaaccaaggattatatatataccatcttgaccacaaaccaagcctcagattcctctatacatatgtcttaagttaccaatacatgttaactgttataatatttctttgactatatgtatacaccatgtagatgtagactatgtatactttgcatcctgctgtttatcacatgcctggcacatattaggcactgaaatagttgcttaatacatcaaaataaaattgaatagggaaaatataatttcttaagttagcattcccctctctccacccaaaagtattaaataaaaaaacaagagtttacgatgactttaacattatgatagagatacaagaaaaacaaataagtatagtaattgaaatggtgcccagaacaccctctttgttgacactaaaagtaagttcatcagaccaaatctgtactgttcagctctggggaacataatttaaatgagacactgaaaaactggagcctgtctagaaagcaacttataattttagggacgtattagctgttttcaaatattcagctaatcagtggaaatgcaatgaagcatattcttattatgatgagaagaaaggaaagagagccctttgtccactaaatatttaaacaaacaaactttgtaacagtgagagatggccaaaaatataaaaagcttaatctggaagtagtgagttgtttttcactggggtgtgggcaggggcttcatgtctatttaaggaatgctgtgttcccatggaaaaccagcacaagacaaggatgccctctcttaccattcctatttaacatagtattagaagtcctgaccagggaaatcaggcaagagaaagaaataaagcgcctccaactaggaagagaggaagtcaaactatctctgtttgcagacaacatgatgctatatctagaaaaccccatggtctcagcccaaaagcttcttgtgctgataaacaacttcagcaaagtctcaggatacaaaaccaatgtgccaaaatcactagcattcctatacaccaacaacagagagaaatctgttccattgcatctgttgcatgcagtgcaacagggagaaatcagtaatgcaatcacattcacaactgccatagaaagaataaaatacctaggaatacagctaactagaggggtgaaagatctctacgtggagaactaccaaacactcctcaaagaaatcagagatgacagaaacaaatggaaaaacattccatgttcatggataggaagaatcaatatcattaaaatggccacactgctcaacgcaatttattagattcaatgctattcctattaaactaccattgagattcttcagagaactagaagaaactattttaaagttcatatggaaccaataaaagagcccaagtagccaaggcaatcctaagcaatttattagagtcaatgctattcctattaaactaccattgagattcttcagagaactagaagaaactatttcaaagttcacatggaaccaaaaaaaagagcccaagtagccaaggcaatactaagcaaaaagagaaaagctggatgcatcacattacctgacttcaaactatactacagggctacagtggccaaaacagcatgatactggtacaagaacagacacatggatcaatggaacaaaacagagaaccaagaaataagactgcacacctagcaaccatctgatcttcaacaaagctgacaaaaacaagcaatggggaaaggactacctattcaataagtggtgctgggataactggctagccacatgcagaagatagaaactggaccccttccttacaccatgtacaaagattaactcaagatagattaaagacttaaatataaaacctcaaactataaaaaccctggaagacaacccgggcaataccatttaggacataggaacagacaaaggtttcatgacaaagatgccaaaagcaattgcaacaaaagcaaaaattgaaaaatggcatctaattaaactaaatagtttctgcacagcaaaggaaactatcaacagagtgagcagacaaactacagaatggaagaaaatgtttgcaaactatgcatccgacaaaggtctaaaatccagcatttataaggaacttaaacaaatctatgagaaaaaaaaaccctactaaaaaagtgggcaaagggcatgaacagacacttctcaaaagaagacatacatgcggccaacaagcatatgaaaaaagctcaacatcactaatcattagagaaatgcaaatcaaaaccacaatgaaataccatctcacaccagtcaggacggctattaataaaaagtcaaaaaatagtagatgctagcacggttgtggggaaaaaggagcacgtatacattgttggtgggactgtacattagttcaaccattgtggaagacagtgtggcaattcctcaaagacctacagacagaaataccatcaacccagcaatatcattactgcatttatacccaaaggaatataaatcgttctattacaaaggcacatgcacacgtatgttcattgcagcactattcacaatagcaaagacgtggaatcaacctaaatgcccaccaatgatagactggataaagcaaatgtggtacatatacaccatggtatactgcgtagccataagaaagaatgagaccatgtactttgcaggaacatggatggagttggaggccattatccttagcaaactaatacagtaacagaaaatcaaatactgtgtcttctcacttgcaggtgggagctaaatgatgaaaacacatggacacttagaggggaataacatacattgggacctgttggagggtggagggtgggaggagggagaggattaaaaaaaaataactgatggttagtaggcttatatctggatgacaaaataatctgtacaacaaatccccatgacataagtttacctatataacacacatgcacatgtacccctgaacttaaaagttaaaaacaaagaaaagctgtggataggtttggtggacaaactaggaactggagaatatatgggaattttacaatagtctcactggagccttagtgggttttagtagtgtttcaagggccatgtgtagggtgagaagacagtggatgcccaccaccaccactaccaccatcagcattcctttagctgaatagctcactcttcatctgtttcatattgggcttctgggtcacattctatttaaagaaagagtttccactcgactctgaggtccttgaatccaaagtatctctcataggtccttggagcaatcgtattggaatttttaaaatgttgattgaatggcttgaggtgaaaggaacctgttgcacagaactagttctctgttatgagtccacaaaggtcttaaattcgataaacattgtttttactagtaagtgtcttagtatcttaaaattatagtaagcttgattcttttctatcatgttggcacagttcagttagcaaataataaaatgaaacaatgatgatatgtaggtagacatattaacatgcctttgtatggagcaaacaataagaagcagatgggacagtctgaggaacgcattaacaagagtttctgaagccaactgctgctgcacctgttaacctggaaggagattaatgcagtagaacagctactgtctttccatatttcttaccacaaaaagatgttttattacattcattgtaacctcttggtaacacattcagaatacaagcttcttcctagtttccgcacatgtctttctcatgatagcatactgtctttgaaaattccatctgctttgatgatttgggctattctatcaaggcaatataaaattgtttttcttaaactttattacaggtcattgagtttcatgatctatagtgaatatttctgtattgatttgttggtatttttattttctcttctcaagctccttgtaagtggggactagcaatgtattttttaattttccgaactatttaaaatctttgatgccaatgattcaacttaaattctggttatatacaccaatgataatattttgtatctagccgatatttaatatttatcatttttttaaagaatcattcactttcatcactatcatagagatgggacaaaaaatataaagactattttacgtatgtatgacttgcttggtaattatttgctgaatgaatgaaaaatacaaaaattgatagttttgctcttacccatcttgtatatctcttccagtgctcattttgcattatgtattagttcatctttgcctttattaagagtagaaaacgccatttcatcttttacatataaaaatgagtctggtctgatacagttactcacatcttcgcttaaatttcttttcttcttcttttttttttttttttttggtggagtcttgctctgtcacccaggctggagtgcagtgacgcgatctctgctcactacaacctccatctcctgggttcaagtgattctcctgcctcagcctcccgagtagctgggattacaggcatgcaccaagccacccaactattttttgtatttttagtagagacggggcttcaccatgttggccaggctggtcttgaactcctgacctcaagtgatctgcccgtcttggccttccaaaatgctgtgattacaggtgtgagccaccgcacccagcccagtgaaatttcaatttgaatttggaagctctactaaggtagtaatgtgaactttcaatattattagaaagctcatcaatctgaaatttaacataaggtaaagaaataaaaagcattaagaccttacttcatatgagagctagaatccatgacctgaaaaataaagtagataaattcacttataaaactataatttaaactcttaacttgtaaatttggggaaattagtggtgaatgggtttctaatatatggaacatgaagcagtaggaaatatgttatgagttgtgacagatattccacctcccacgagactgtgatttttagaatcgacgtgttataaaattgatctgaactttgtccctgatgctggaaaagtggcaacctgtgactgctctaaagtaagctaaaggagctgaacaaggctgggcacagtggctcaggcctgtaatcccagcactttgggaagcagaggcgggcggatcatgaggtcaggagttcaagaccagcctgaccaacgcggtgaaatcccatctgtactaaaaatacaaaaattagccgggtgcagtggtacatgcttgtaatcccagctactcggggagctgaggcgggagaatcgcttgaacccaggaggcagaggttgcagtgaaccgcgattgtgccactgcactccagcctgggcgacagagtgagactgagtctcaaaaaaaaaaaacaaacaaaaaaagaagctgaacaaatgctggcattcatacatggtttgagaaatagccctttttcatttaagggaaagacttactgagatccagattgagaaaacaccccatcaacaataaagtggctcaggaaaatgttttatactagcacatcttcaagtttctacttaaggctattctacatgaatatttaaaaagaggagatgtcaaatataaaagcacaagaggccccgagggcttagtatctttatttgcgttaaggtttctcataaataattctatttggggatataggctctggtatatatgtaataaatgtgagtctttttaatatcagagttacccttaggatagtaagtgtatttatttcaaagaaatataaaaataaaatgaataaaatatttcaggtacctcagatcattgcaaattagtcctcaagtctctttcagtttttcttggattatatgaataatgctttgggatagaggaaactcaccaaagtatatttctgaggactgggggtgggaaaggtttcagaaaggagaaacccatgggaagaatttttctactgactgtcaagtaattcatctcaacagaagaaaagctgattttcgatcagtttaaggtaatagaatatgtcagaattcctggggttttctttgttcaatagcccacttaacctgctgcagaacaccctaggaataacaaatgaatcataaggtagagggacattccagcacacttgttttcttcaaatattgatattttccccttaaaattatatgtctagaaaagcttttgctcggacagagtctgtagggccagaaatataaataactgtcaaatataaagctgaatcgcctccacaagattttaggaacttctgggctggggaaatgtggcctgaaggaaggctgctggtttggccactctctgtattccatcagaaaaaatggtggggtataatcagaagttgaaatgctcacagtagttttaccccatggcttgtcagctgaatattgcgacaatataggaattcttcatcgcagaaggaatgagcctccctggactgatgattttctcagtttatggtgtgtgtgacgtttttgtaaagtggcaaatagttgggggcatgagctagaaggtaactttaggaggttcaaccaaccaagtaccacctgcgaattggacaaaattcaatggacaaaagaaaacttaattgtcagcttactcccgccttttactcccgggacctagcttatagcacatggttcataaaagactctataaatgattactgaatgaatgaataagtgaaagtgcacaaatgaatgtatctctgagattttaagacacttttgtgttcatgcgtcttgcctacctgtctccggtccttctgaattcataaaaagaagaaagttcattttttctggaatgactgatcttaggaaataggaataagtaattctgatgggtagaaagtgcagtgtatgaagattcagaagggtaaggccaattaatttaaacactctgagtctatgttctaacctgtaaagaaggctgataatatttgccttctctgctatggtgttcccgaattgtgctttccaagaaatataccatcacacaatatatggccgtggtgaatacagtctccaatgtccttctccccctgcaatgtgccaacagagtgatctccctaagcatacagggtggtgcagtgtaaaggcacactggtttctgtttgaattccagctttgctacttactacctccataatgtgtagcaagatacttcatcactcacctgtaaaatgatgataaaatgatacttatttctatgagaattaaatagctgatacaagtaaagagcttaaaacagtatttggcctgttttaagtgctcaatagatcctagatgttgtcattgctgttactactgctgctgctgctactactactactactacatatttgtttttggaccctacttaatcccataggttgccacaactactgtctacataatgaaatctaacccccaagtataggatactggtttctaaaaatctagttcatggctatagttctagcttcattcaccaccgttctactagcaataccagtccatctgtatttcctccaatagaccactctatttttttttttttttttgcctctgcacctttacactggatgtttattttgcctttagtcacatatccacaaagagatgttctgggctccatatgatggagttgcatacagtgctgagcttttctttcagggacatattcagaaaggatgagtttttgattgttgtcaaatttgctgttatgctgattttttttagaactgtttgggcgactaatacaaattcatccaaagcttgttaagaatacattgtaatcatcagtatttttaaaaagcgattcttcattctttaccattgtgtttcccatcccaaggatttcttcagattaaaatattaaatgggacaggcaacactttgaatgtaaaggagaaatgggaaacactaacacaatggtggcatgataggggatgaaacacagaaagttggaaccaaaggggagcaccatcgttcatatttatgtgtaaggaaaagaacagaatgtccttgggtagtttactatttcttaataattctcctcacttttaggcaagcttgccagtttttttcagtggggatcacaaatgcctatctgtctgtctgtctgtctgtctgtctatctatctatctatctatctatctatctatctatctatctatctatctacctacctacctacctatctaatctatctatcatctaatatattatgtgtgcgtgtgtgtgtgtgtgtgtgtgtgtgtgtgtgtgtgtgtgtatgtaacgatttaattgaagcaatggtaagacattacaacttcaaaaatactgttttacttcacatacactttacctctaggtttcatagcaagacaatagatgggtgtagttttagtattatttacttttatttgttaattcaaggcactatagaaatacttaatctgtttaaaccccaaacatctctttaaaatattttatgtgacgagcaaacagaacatcatgatctaataaaaatgaaaatgtttttgatgttaaatgttgaggtaaaacttttgttcagttattataaaataatgacattttgagaacctcttatttttaattttatcgtctctaaaattgagacaatcacatcttggtatcgataatttttgatgcatgatgtaatatttaaaggactttaaaaatgtaaaatgctgcataaatattattgctctgcttaacagtgtttcaaatacatttttggaaaaatagcaaagtaagagataacatgtatctaaagttctcatcccttatcaactaaatattatgaaaaccttagcttctcttgcttctccagaatgacagattagcttcagcctaccttagactaggcatatggaattggcaaacgctctccttagcaactgcaaagttcaccgcagatgcatttaacagaaatagcacagatacaattaagcaggtagaaagaaagaatgagcatgtaaaacacctacaatattccagatttcctgctcacttaattggatgattcagatacctctctttcataatgtccaggtgaaagaaatgccggttcctcttatttctctacatcaaactaaagctccacttaccagagcaaacacaagtacaatctgttatgttttggactgtctaatccattctctgtagtttcacaagaatctggtgagcttacatggcatccagagaacagggtgatgagtaaagcccttaactctacattgtctaaagaacctgatttattcaaagaggaggcagctctctcacttcttattaacagagggtagagagtttctttcccaaggccaagaggggttttagctattaatacactttctctccctccgtccctggtgtgtgtgtgtgtgtgtgtgtgtgtgtgtgtgtgtctgtttctctcactgtcaattttgagtggggtttcaaggtttaaataaggtgacaagtctagtagaaaaatctctgaaagagctatttgtagaacattaactgactagttgtgtgactttgtacaaccagcttaaggattcagttttataacagataagtttagggaaataaattgcactgcacattgccttcggtctgttgtacctcaaatagcttaggaatctgttttctcctaaaacatcttcctggaagctgggtttccgctccaccccacctcccatgtgtttatgcattcctctgctcctccccttaactgagaatcctcattagaggcctgggtaaaatgtttcattgttagagttataatatatcaataatttacattaccttaattttgtaatttcccagggcattttgaaatgttatgataacatgaaaaatgtatgactttcctcaatgaaaagttaattaacaattgcttttattcttcaatgaacagctttatggctaaattattactagttttgtttttaattagatgactaaataatgcaaaattagaccatctttgtcctgacactgaattagaccattctttggcaactcgtgtacaaactattttcatttttaaaaaaatgtatgattctgagaacaagtaaatgcaattagaattgtctttcagagggaaagtggccccaaatgatgtcaagaagccagttttatgataaagatgtctatttttatgaaataaaagtaaggagaaaaaaagaattaatacaacttcactttgagattttatttttttaattcttgagttaggctgaaggccagatttgtaattgctcgtgtatgtgctttctaaaacttgcttaaggaaaactggatggattttctaaaaggcaattaaagatttgcagttgaaaaatcatcctccctcataagtattggtgtatacagtggtttccctgcatggaggatatgctggacaatatattgagaactgcagctccaggcaaaattaaactagtgttttttagagatactaggattagcttgtttactaatttgttaaagcagctgcgtttacgaaatacataagccttaagttttaatcttagaaacaccctttcccaaatattctaacaagctcaatggtcctctgcctttgctgatatttagaacatcacgagagtctttaaaacttacagatgcctaggtcccacctgggaagtttctaatttaattggtttaggtggcaacctagtcactgggctgtttaaaagctccccaggtgactataatgcacaggaaaggttgcaagccattgaacttgtaaacaatatagcagctcccatacaaaagcccgtaaattcaaagaaaatccagccatatgaacaagaaaaaaaatgtcaacgaagcagggacttcataaacatatgtttgcaacaacacatcattgaatatgattaatttgatatatctgttttgttataaaatgtctagaaaaaaatgtaatgtaacaaaaccagcaagcaatttaaaacaaataggaaaagatgattagtagatcatatgatataatttttagataatacaggaatcggacattgaatttacgttagatttttatagacagatatacagaaaaacactcagagtagacaacaggatgttagcagtggtgctgcttaatgaaaaaatgagttatctgtacttttcttaatagttattgttgtatctttttatggtaaacatacattgtttttgtaacaggagagaaaaagtagtgttctttccttgaaccaaaaaaaaagtaggccatttaaaaattaatgaataaggaaaatacacatgaaaacttctggaataagaacaaagctgtaatcaaagaaaattaatagccttaatttttttatatttgagattaaagggaaaataagagaactaaacatttgattctgtaagaaacctttaaaaagcagtacaagaaataacttcaaaaatactatattgagaaatgctttcaaacaactaagtatgaattatctgtttacaaaattccaaaccatgaaaatagtatttaaacctctatgttcatgttctaaagcccttataatcttgattatgagacttcaaaaaaatagcatacacattgaaaactatcaaccaatctcaggaatacagacgttcaaatcttataaaacatagcagatttagccaataagagaagaagttatcatgccaaattggatttatttcaggaaaacatatatgcctactataagagaatctatttacatccttcattgtaggtaaagatcagaaggaaaaaatatacaatactttttagttatgaaaaagtattgataaatgaaaagaatctgtccctaatttaggagtagaaacaaaacttttagcaatgtaagaatagatgatagtttataagcatgaaaaatattgtctatctcaaaacaagagccaactctgtgatcaatgttgaaatattgaaggtatcctcattaaaattagaaatataactagaatgactaccaaaactgctctttttaaatgctattttgcatattctagtcagtgaaagaagccaagtaaaagaaacaggaagtataagtattggggaaaaaagtcaaattattcatattaatagatgatattgtcaacttggtactaagtaaatcaacaatgacaactattataactaatgggaaaaattagtcccaaagctcattaagaaaagaaaaaacctagaaataattaaatattaattaaatgtaatttttctaaatgctaatttctcttttaacaacctattgaaaatcaaagctatcattttccacagaagttcaaaatgtgaaattactgtgaatttatttagcatgaaatttggtgatatacaagcctttactggaaaaataacagaatatttgcatccatggacagatataattttatatttcttggtgggaatattaatattttagacatataatttactacaaattaagctaaaatctgatagaaacacataaaatttaaattggggtggcaggaagacattggatgtgacaagaattactctaaagtttatctggcagcaatatagatgaggattaatagaaaatgttgaaaaccttaaatgaaaggtcatttgcccatgtagctattagagtgtttaataaaacttctactggctgggtgcggtgtctcacgcctgtaatcccagcactttgcgaggccgaggcgggtggatcacctgaggtcaggagttcgagaccagcctaaccaacatcgtgaaacccagcctctacttaaaaatacaaaaattagccgggcatgatggcaggcgcctgtaatcccagctactcgggaggctgcggcaggagaatcgcttgatccagggaggcagaggttgcagtgagctgagatttcgccactgcactccagcctgggcaacagagcaagactctgtataaaaaaaaaaaaaaaatctactaaaagtctatacaaacagattagtgaaacaaaagagaaaatcccaaaatatgctcaagtgtatataataaaaatggaatttcaaatcagtggatagagatggactatgaaagaaatggttttgataatcatgttaaaaggcaaaaccctgctttacacaatgcagtgaattaaatttcaccttgaacaaatattcaatcataattaagcttaagaagcccaaagaacaggaagaacgataggtgaatatttctacaatgaggcgatggtagagaactatgtagaaatgattttaaaaacccaaaatttaaaatggaaaacacatagataatttttaaaatctgtacattaaaaaccagtaaactgaaattgaatcttacaaatcaattcagaaaaataaatgcattgcctaattttaagcatacaggaagaaagtgttagacctggaggtcattattttaagtgaaatgaaccagacacagaaagtcaaatattgcatgttcacccataattgtgtgctaaaaaatgtgtacacatgtacacagagagtggaatgatagacaatggaaacttagtagggtgagggggttggagtggagtggataatgagaaattaatgtgtatgatatatttgggtgagggacgctctaaaagccctaacttgaccactacacaatctatgcatgtaacaaaattacacatgtaccccatatatttggacaaaaagaaaataaaacacatccaaaggtatatgaaaaaatgttcgatctcatttgtaaccaaataatgaaaataaaaataacttttccttgtatactttgtatgcttctgacagaagactgaatcaatttatttcatgagagcagtttgcaataccaatcaagagaaagcgtgcttacacttgactaagcaattgcatttccagggaaattatcgaagaaatgcttacatctatgtgcaaagactgagttgtacctatatttattgtttaattgttattacagtgaaaaatggaaacaacaccagtattcatcagtaggaggctactaaaaaatgatatatctctaaagaagggaaatttaaaataaaattttacaggtgattgcattgatattaaaggtaatccaaatacatacatgaaaaaataaagcagactgtaatacacagtatgtatacatataatgctgtattatgatcccgcttatatatgcatatatattaaaatataaatttttaacctctgggaaatgcattcctacctaattttaagtctctcattttttcttattggaattttaaaaagtgtacaatgcttattaatgaatataaatttgtttgaatcaatgttttcaatttttaatcaaattatctgtacatgattcaagtaatttttacttcataagttcttttatttaaatatgctgcattcctctctcatttctcactcctcagaggcagatatttgagtcattctctttttctaatgcgtgacaaatctgtaataacatgtttatatctctaattcttgattttctcattttttcatggtctacagtctctcttatgagagatgaaaaattatctcatttatatctaccccatgtatttgttctattaactaatttttcttttacatgaagaccttaaatgttaatttttttcttcaaaacagtgtcaaaagtatgtcttaacccttcacatgataaaatggggattttagtggtcctccatgtttcttcacttctcctactgaatttcttctcccaaattctgtaaagtctacttttaattttatgttgagttgcattccttctgtgttctctaactatgattaggtctcgtgttttgtcaaagatttattctaaaaattgaaaacatataaacagtatgtacactattattatagcaccataaatatatttcattgcagagtctattaccgtgttgggcttatatttcctttcctatgatttccatggcaatttacctctgctactttacagaaaatttcaagattcaagttaaaatggattctctttttttttctttttttgttttttgagacagagtctcactctgtcacccaggctggagtgcagtggtgccatctcggctcactgcagcctctgcctcctggattgaagcgattcttctgcctcagcctcccaactagctgggattataggcacacaccgccacacctggctaatttttgtatttttagtagagatggggtttcaccatgttggccaggctggtctcaaactcctgacctcaggtgatccacccgcctcggcctcccaaattgctgggattacaggcatgagccactgctccagccaaaatggattatcttttcttacactcagtaatctctcaaattcaaataacgacataggaaattcctaagtctattgagtctttatctaccaaatctccctctctttcactttctctgtctctcttatgtacacgtagacacgcacacactcccttctcaaaaggtaagagaataggatggtttgtaaaggggaaacgtctctggaaacacccacactttaataatgtcttaactaatcacattgcttgggtgtttttgttattttgtagtttgcggttttgtttgttttattttctgataacctgcagagtaggaaagaagagagtccagaaacttgttgtaaagctggacttcaagttggaagaaatattggaaggaccttttaaaaagagagttgtatgatatcgaagcagcctatttccctgaccccttcccgggactcgtgacagggttgcctcatttacctagaccagttttcaactccttatgggagggagcatgcaagtgaattccaggggtttggggtacgaatgatcctgtcacccaggtactgagtatagtacccaatagtcagtttttcaacccttatccccctccctccttccccttctagtaatccctagtgtctatcgttttcacctttatgtccatgagtacccaatatatagctcccacttacaagtgagaacatgtggtatttggcgttccgttgctgcatgaattcgcctaggataatggcctccatcacagctgcatctgtgttgctacgaaggacatgatttcattctgttttatggctgcatagtattccatggggtatatttagattttctttatccagtccaccaatgatgtgtatctaggttaattccatgtctttgctattgtgaatagtgctgtgatgaacacgtgaatgcatgtgtctttatgttaaaacaattttatttattttggatatatattcagtaatgggattgctggattgaatggtagttctgtcttaaattctttgggaaatctccaaactgccttccacagtggctgaactaatttacattcccaccaacagtgtataagcattcccttttctctgcggcttcaccagcatttgttgttttttgagtttttaataatggcctttctgactggtgtgcgatggtatctcattgtggttttgatttgcatttctctgacaattaatgttattcagcattttttcatatgcttgtaggctacttgtatgtcttcttttgagaggtgtctgttcatgccctttgcctgttttttgatggcgttgtattttgcttgttcagttttttaagttccttgtaaattctagatattgaacctttgtgtgatatgtagtttgtaatgattttctcctgttccgtaggttgtctgttactctgttgatagtttcttttgctgtgcagaagctttttagtttaattaggtctcgcttgtcaattttttggttttgctccaattgcttttgaggatttagtcataaatgctttcctaaccccaatgtccagaatgatgtttcttaggttttcttctacaattcttctagtttgaggtcttacatttaaatctttaatcatcttgggttaatttttatacatgtcgaaaattagggatccagtttcattcttccacatatggctagccagtccatttattgaacagggagtcctttcccattgcttatttttgtcaactttgttgaaaatcatatggctgcaggtgtgtggctttatttctgggttctctactttgttccattggtttatgtgtctgtttttgtgccagtaccatgctgtttttgtttttgtttttgctcttatttaaatgttataaaaattgcctatatttaagatgtataatgggatgttttgatgtgcatatacgcagtgaactgattactacagttaagctaattaacatatccatctcttcacatagttattttgtgtctgtggtaagaaaacttacaatttactctcagcaaatttcaagtatacaatacagtattactgactatagtccctatgctgtgcattagatctccagaacttattcattgtatgtaactgaaacgttataccatgctgattcggttgctgtagccttatagtatagtttgaagttgggtaatgtgctgcctctggctttgttctttttccttaggattacttttgggctcctttttggttctatatgaattttagtatagcttttttccagttctgtgaaaaatgatgttagtggtttgataggaataacatttaattcgtagattgctttgggtagtatggccattttaatgatattgattcttctaatccatgagtatggaaagtttttctatttgtttgtgtcatctgtgatttattttagtagtgttctgtaagtcttctcatagagatcattcacctcttttattttttatggctattataaatgggattgcatacttgatttggtgcttagcttgaaaattactggtatgtagaaatgttactgatttttgtatattgattttgtttcctgaaactttactgaagtcagtgctatttttagatggatatatgagaatatttaacttatatggagagtcatagaaattacacaatttgtatttcatacatcatccacacacatgctttctttacttaccagaatagtggaaatgctgcataaaatgaacttaatggtttttatttcctttcttcataaatgtacagtttatcaagaagatgccctttggcttactgacgtgtaaggagggactaaaaggaaaggaaaaagaataggtagctctaacttttcctttctgtctacatcatcattttttattgcaaggtggttggccaatataaggaaggaacaccactaagaaaagatattatgtggttttttggtcattagtgtttcttagaatgtcactcacttcttcctgcatatatatatctcaaatatatatatacacgtatatacacatatatatacatatatatctcaaatatatatacatatatatctcaaatatatatatatacacatatatatttagaagattatttggtgaatacactattagaacaaaaagaaagaagtattagcgaagtgacagggtatttcccaactcagatatatgatacctgctaatggactgttcgtgattataaatgtagtatatgctcattgtagacattatgaaaaacgtaaaatcccctataattagacctctatttgtgctaggcacatgatgacttttcttgctctgcaacaactattttttttctcttaaagtttataatgttgtcagtattgtcggatatcctcagggattccatcatcttttcttaattgtggttaattacttaaccaattattacaaattattttcctataatttattgctcttagtatcaaacaattaaacaccctaggaaatgtcttattacttgatctatgaactggtgagaatctatattctacataggggcttgttttctggttttaaatctaatacagtcgtttggcaaataaagacaaaaaataaatgttgtctacctacttttcaattatccaagtagtttaaaataaaaacatccttactgattttttaaactcttatataattgcctaattctacagtaactggggttggtagtaactaaaacctgttgtattcctagtgatgcccaatgagccttgggaaatgaataggtgggtatagtccagttgctagaaaatacttgcttgttactgacttatctgagaggaaataaacactttcatttatcagggacagagtataaagtgttcctcactgaagcatttctaaaagctctacagtcctttgaatactgataaggactctgaaatgcaagggaaaatatgcaagtaatctggactatcacaggttattttatgaactgctcatatttttactcctttgataagtattatttcccccaaccccaaacccgataaattcgataacccttttcatatataatattatcagcaaggcatcttagagtttcctttaaaaaatgtaaattaccaagagaaccagaatgattttggggctcataatggtagatcttaaagagagtggaaagatcagtagttttcgcattttgctacacattggtggagtgtttacaaacagtgatatctgcgttctatttccacagagtctgacttaagtggtctgtaatccgagcatctcagtttgaaaagtttcctagataattttaatgtgtatccaacgttgaaagccagagtaaaatgaaggaagttctggggcctcagataagcaacttcactacttttttcaggttctttgaataattgacatcatccccaaattcaaatcgttgatagtcatgatgagtacctgttttactccagaaatctatataatattggttacctcagtgcttgctcttaacttccataatcaaaggaggaagagagactcatcgtgttcagatacaggttgtgtaacgtgtgtctgtaaaatactaatgtgattgacttcatccatccattcacctatccatccatgcatccatccatgtatacctcgtgtacctccattcgtctactcatccaatgtctctgtctaggctccaggactgctgccttaaggttgtttaccaactcagtaggtagtatgttatcctcaggctttggaaacaggggggtttagttaaagagcaaaccaactcaacatactagattaacttgaaagggaaaagttatgcttagtgcataaattctttccctcttgtcctttcaaatccatttttcattctttaccactgtgctttgtgtcctggggactgccctttaggaatggcatcagagttcctttgccctacagtttccagttgagacaggctgcagcaggaggagtacagtggataagaaaagggtggagtatttattttcatgtggccccatgggatttccacaggttagctctgaacagctaacattagaccagagcttctgctggacagttctctcttgcatttctattgggtctggctctctagttcaggaaacgtccttcctcttaacccttgaggtctacagttaactctccgtcatcccttcttgaatttcctaacactgagcatatctctgttgataacccctttagcaaactggcctcacataccccgagattgagaaatcaatcctccagtttctaccgggactctgattgagttaatgtgggataatttgcttacactaccctcttataaagtgactatgtacattagcatattaactcctttgaggattttcatttacttttgttattaaagcattacacgttttttgataatgtgtaggagactcaatcatagccagaagtgtctcagacgcaagcacctgtaatgattcccttatatacagttttatcccaccagaaattgggactaggcacaagtgttctaggtaacatttcaggatcctactgtcataaagattattatggcacaaaaactatttggctagaagtatccccagactcctctgtgccacattatcttcctttatccagttatctgaggatgtgcttgcagtggcagactagcttttggggaaattttatttcaagaaaaaaagcagggaggaagaaaagggtaagaaatgaggaagggaagaggcccatgggctaggagtgggctgtcctgtttctgggaaactttgtgaaggtttcaggagtagtagtaactcatggtgaatgaaaatgagagggaattgttggcttttaaagtaataggatatgcccctttatgatgggattaagagatacaagtaagctgggcgcggtggctcacgcctgtaaatcccaacactttgggaggccgaggcaggcagatcacctgaggtcaggagttcgagaccagcctgaccaaagtggaaaaagcccatctctactaaaaatacaaaattagccaggcgtggtggtgcatgcctgtaaccccagctactccggagtctgaggcaggagaatctcttgaacccaggaggcggaggttgtggtgagctgagatggcgccattgcactccagcctgggcaacaagagcaaaactccgtctccagaaaaaaaaaaaagagatacaagtaaagttatgaaatcacctgtggtttctagacagttttttttgtgtgtgtgaaatattaagaacagaatacatgtgctaaaacattttaaaagcttaataaggtcttttaaatcttgcctcttccttttgctcgtctaatattacctcctatgtccacccccacggattatttacatttaatgctttctagtgaaatcattaaaatgagatttatggattattcataataggcaggatgaaaaaggaaggtgaggcgacagtgatccttccttagctgttaatggataaggagtttcacagcaagaggaaaaaggcataacattagtattaccggttgtctaagggggagagatagaattgtttttttttccttgcattttctgtactctactcttatttccaaatattctttaatgtttgtgtgactttgtgacttctatattcagcgcaaaaaggattaaagaattaatttaggaaatcaatttacactgagtgtctccagtgccagagagggagggaaggacattcgtagctacagtgttcataatagcaaataattgtattatggtcataccatggaatattatatagcagtataaataattaactatgatcacatgtaagaatatgagaaaatcataaaaacataatgtagaggtccacaaacattttcttaaagggccagatagtacatatttcaggcttctaggtcatattgcaaatacctaactatgttgttgtggcatcaaagcagccatagttattatatgagtgaataggtgtgagtgagtctaataaaacttcatttttaaaaactgtcagggaggccgggcgcggtggctcacgcctgtaatcccagcactttgggaggccgagatgggcggatcatgaggtcagcagatcgagaccatcctggctaacacggtgaaaccccgtctctactaaaaatacaagaaattagcggggcgtggtggcgggcgcctgtagtcccagctactcgggaggctgaggcaggagaatggcgtgaacccgggaggcggagcttgcagtgagccgagatcgcgccactgcgctccagcctggggaagtgcactcactccagagccggggagcccatgggcggtagtgtgctgacccttgtattagacaacactccagaaagctcaagcataggaacacctaatgaaaatattgttttggcatacatgcatgtgtgataaatcgaaaaaaccaacacaaaacaaatgagcaaacaaaagaaatcaaaggcaatgatatgacaatccccagattctggatggtagttaatcctgggtaaatggagggaggggtacaaaagagtgaagaactagtgtaggagcacataggttcaggtgtgagttgttgctaatatttcagttattgggatggacatatgtttgttttattattgagctttgtaatttacatatccattacatatattcttttatgcatcaaatatcacattacacaaagggaaatcataaaaattggggaaaaattggaggcaagcatagatcttggggcccagtgtagcatgcttttttctatttttaaatttaaaattgtttttagagatgcggtatttctctgtcacccaggcttgaacccctaggttcaagcaatcctcctgaatagctgggattacaggtgggtgccacttcacctggctaactaaaacaaaattcttttaaagatatggtctctctttgttgcccaggctgatctctaactcctggcctcaggtaaccctcccacctcagcctcccagggggattataggcacaagtcagtgtgcctcacttccttcaacattcttaaatacatcttggaagcacagtgtttattaccttgtttctaaaagagatgcatctattgtaatcatatttataatgttcttatatatggttttcattagttttactgaaactctcaacctattgttttttgatgatgactaccaatattcattgattcactgataatctttgtaatgtccttaactcttagggattagatgacattaaatctttatcaagaagtggattttgttacttaagtattttagtagcaacaaaattggtcacaacgacattccactgaagcagaatagtcagaaagcaatccaagccgcagaaataaattaggttgagcaagactacacctaatggcattgagataaagaccctactcctgactcactgccccgtgttctagtggtgtgcctgctctgcaattctccttaagttgatgtgcatctatctctttaggaccagggggtatttagtctgtaatggcttttccggcaacgtgtctcatttcagctgcttcagttgtcgagataacactctcgtcactgcctctctgatggtttcccattcaacagcagtcatttcatcttgggacacttttcctcacagtcaacagtttttcctttgtgtaattaagtctcatttttttctggatagatccatttgtgccagaactcttctgctgccttgaagcctgcaccattcagttatttttagtgttatctctttcctttcattagcacagagctaaattgtgcatattttgttctttcagctttatacagattaagatcttctagctccttagtcattcattttagctgttgcattgaatttcctacagttcatttaaatcacccagttcagtttaatatgcccagaataaataaagcatcattttttttcacatctaatcacctaccccgaccaatggcaagtgtaaggattataaacctttgtgactttgcctgtttactcccttagtaggtgagctctgagccaaaatataaattcattaaagtttttcttaatatctctagtctctacttctggctcccttccctcagggtattatcccctttacaaatatttttttgtgtctttaggtttccatttgttttttaaaaatacattcttatcaaaacgggaaaatattttcccatttctttcataaaccatgttttctcaatagttatctctaatcaaatacaagaaacagggaaataggtagtgccttacaaaggaattttagccatatacgtttggataaggtgaattttccatatcctggagatggttttgagtactcaggaggctacatctgaaaaaaaatatatagttattctctatctgggagtcaacttaattcttttgatggaaaaatagaggctgtgaatccccagctccagctggcagagatcactttgctcagaagttttgcacgtaaaaagaaacttcttttctgggatcactgatttatttcagctgtaccctgaaactggtagtcagatacaccctgtaaccagcagatctgatattctccagccttttcgggcttgtacatcaatcgtttaaactacactataatggggatcatttgccaaagctcattgccattctcttctagtcataccaatttataattacttttctctcaatatgtacccacgactctcctttcttcacccttatgatatttattcaaatattaaatgttgccctttttttctacctttattccaaatgccttagaggtctggcgtaaactatatggctataacctattgcatttttaccccatagatggaaaatgtattggtgaattgtttataaggttggaagttcccctgaaaataaaatccacccaccccactaggggagtacggaaactatatataatatgacacacatcgctattacttttattacatatgcttattatttattgttcaaattttcaaatatggtcctgcacacaggcaattttcacaaaagagcagtatcagtgttaatcagtttgaaacaggaaaggatttgtgaccccaccttacaaaatacaattccttatggttacaaaatctcattcaaatggattctattgtagccatatcaataaggaaactgatctatcagccaaaatcggaaatagccctgataaagtagactgagcttacattcatgcacagatgtttgctcattatttttacttgataaggacagatacgtttgtgtttagcataatgcgtgtgtgtatatttgaatagattttctagaccctcattttagttctagtaacaattgtctggttctgaatagggactttccactttacagaagcaggcaaaatttaatttgtcatagctaccactgaacccatttcctttatatactcaatctgctttgacacagtagatattggagtttcaaaccttaaaatgaaatacagctttatgatgaaatataagttgatatgaatactttcaatatacctatattctatgttacactcagttagctggcatttggtcttcactcatggacattttaaaaactcatacattctttagtgtttgataatgtgacaaatcaaccccctataaaattaactttaaatcaattgatacgttagcatgtgagtatatgtgtgtgactatgaatacatacttatataagcacacttatatgcttatacgtttgtttgaatctctcactgaccttagccataaaaacacttttattctgttgatttatacctcagcctacatgtgaacaaaagattcagcaaatcagaataacacagttactctattttctaatttatttgtaataaatatgcattacctgcataacgtttacatcaatatgggcatacattacttatgcaatgtaatgatctaaataacgcaactatcgacagtaaccacgcactctccccctagcaattacagaatacagtttctctgttgcacaacatgcctgactatcgtaaatttagggttatctccttattaggattccatttacactcttaatgaatcatatttattttatagcagcttattagtaaagttgactgccaagatataggcaatacatacaatttcctcaaaaactggggctttcactgttaatttaacaaacctatatgaatccatataatatatgaatcatatgaatatatataatatgtaataagataaaatgcataatttaacatatatgaaatatatatagtattaattgttaatatgtattaatatagtataaaataatatatataataaatgtataatatataatatatgaatcatataatagaaaaatatatgcatagacttgagttaggtgtaaagaatggaaaaattaaaaaatagtgcacttgatgagttcacaacctagtatagtgtgtcatagagaatgtagcattttgtgtatgcaatagtaaatatatataatgcaaaagaaatgaatggttttgcttagggtaggaggaatggggtaatatttgagataaatctcaaagcatgtaaagatttatcaaatgaagaattggggttatggaggagtaggggttgcattccaggagggagggaccaacatgtacaaaagcttaaaggaatgtaatttcatagtatctgggaaggacaatgggtagctatatgtttctgaaatcttgaatgcttgggtgaaataccaaaaatagggctagaaaagcaggttatgattagattgtgaaggcatttaaaagcgtcttgattagttgggaaataatttctacaacgttttagttgtataaataacaaaagcttcttttaatccagatacttagtggaagttcctctttctctaagtagaatactagacctaataataataataataataccgtatcatatatttttattacttttttggttttctgactactttcaagtacagagatggtccccgacatacagtagttcaacttaacaatttttcgactttaggatggtgcgaaagtgatactcatgctgtggaaaccatactttgaggacctatacaactattctggttttgactttcagtatagtatttaataaattacatgaaatattcaacattttattataaaataggctttgtgttttatgatttttttcccaactgtaggctaacgtaagtgttctaagcatgtttaagataggctaggctaacctatgatgtacagtctgttaggtgtatcaaatgcattttcaagtttcaaaatttccaaactatgatgggtatatcagcatgtaacttcattgtaagttgaaatgcccatcaaagatagactggataaagaaaatgtggcacatatacaccatggaatactgtgcagccataaaaaattatgagtttatgtcctttgcagggacatggatgaagctggaaaccatcattctcagcaaactaaaacaggaacagaaaaccaaataccacatgttctgtcttataagtgggagttgaacaacaagaacacatggacacagggaagggaacatcacacacctgggcctgtcagggggtggggggcaaagggagggatagcattaggagaaatacctaatgtagatgacgggttgatgggtgcagcagtccaccatagcacgtgcatacctatgtaacaaacctgcacgttctgcacatgtatcccagaacttaaaatataataataatataaaagaaaagtatctgtgcttgatgggttttgatatcctcagtaactatggccaattagttgaacatggcacagtattatccatttgcagtagaggaaacaaaggagaaaccagaggaacagtgagagagagagagagagagaaagctgctggtcatgtcctctttccagcatgtcaccctccatattcttcttcaaatcaaaaaacgtagaacggaagggagcttagtagcattcagctctgctacactgcacaccagctatacacacaggcaatcaatatggtttggacacagctgatataatttggtggagctctaattgaatttttccccttcttaatataattacacctacagaacgtctccaattaagtgtccccccatcagtctcaaaattaaatataccaaatggaactcattatctactcccacataaaccagctcttcatgactctttcccctttctattaagcaccactgcttccaggctcctatatctgaaatccctgaagtcgcttatttttgtattcctttctccatcccgaaatccattcagtcactgaatgctattgactaatgtttgaaattatatctatgcataccttcctttacgttatgggtaaatgtttttggaatgtgtttaaacagaacaaggaattggtgaacaaaagaataaagccatgcataaacaaatgtttattcaccgttttcattatatttgtttgtagtactgcaacctaaagtttgtaatgtctgagaatatctgattgtaagcaattaccccaaccccatgtaagttaacagtgttataactggtacgtctccttataggtgaatttgttcaaagttgcttaattatattttaaaaatctcttattttagaaagaactctcaattgctttactctgaataagataatactgtttagaagacaaatcattgcaagttttacatctgtaagtaggttacctgatgaaacggattgaaaaactgaaggcaaatattgaatgttagattattcccaggtatctgacttcatcttcttacttgctaggtgtcattgttaatgataatttaaaaaatcacacatacctacgtatccacatatacaaaacagtaagcagtcatgctattgaattcacaaatatacaccaaaagacaaggggaaaaatataaacaacagctttcttactagcaagcagagtgtggcgtgaggtcaaatttttatgacgaagagcatacatattcacaaagtaatttatctcaacttatgtagctggaaatggagttgatgggttctgaaaaaagcttctagatgacattaaaaaaaggggttcttatgacaaagaaaaaaattacctcaaagtagctttcaaagagatcgaataaagtcatttcatgaaatgcgagactaaaaaacatgccagcatttctaatatttctaatgttttatatgatataaatatgaaatataaaaatatttaatatttttatcatagaaaattaatggcatcaatttcttatcaaaatcatgcatacaattgattatatatatttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgaccaacatggagaaacatcatctccactaaaaggcggaggttgtggtgagctgagatctggccatcatactccagcctgggcaacaagagtgaaattccatcaaaaaaaaaaaaaaaaaaaaaaaagaaagaaagaaggaaacttgctacccctcagtaaacaagttatatttccttcataactttcttcctataaggcaataaacaaatatttattaagaacctatcatgtgccaagtaaataagtactctgtcaaaacaagttagattcagagtgggctggaatgatttggacagaagggaatgtgagaaaggctagataagatggaaacttttctgccacaggcataccttcccagtagacgaagtagagatacaaataatgtagcgaagggtactatggaataaaaaagtcaataaatttatttatttagtgattacagctacgatttgctaagcaattaatatatgtcagacattaagccaagacctctgcagatgatgccatgtttagatcttataacaacctagtaaatgtgttaggatgatcaaatccattttattttatttaaattaaatagttaattttaatggatagaaaaaattgtttatctttatttcattcaacatgttgttttgaatatatatatatgaatggctcagtcaagctaattaacatatttattacctcacatgcttatttttttgtaggaagaacactttttttttttttttttggagatggagtcttgctccgtctcccaggcaggagtgcagtggcttgatctcggttcactgcaacttctgcctcacaggttcaagcgattctcctgcctcagcctcctgagtagctgggactacagcctcacgccgccacatcctgctaattttttgtgtgttttagtagagacggggtttcactatgttgcccaggctggtcaggaactcctgagctcaggcaatccgcccgcttccgcctcccaaagtactgggattacaggcgtgagccactgcacccagccaagtgaaaaacacttaaaatctactctcttagcaattttcaagagtataatacattgttatgaaccacctgtagaatcaacatgtacaatagatctctcgaacttatttctcctgtctaaatgaaattttgtattctttgatcaatatctctgcaagcctcacaccctcctcccagtctctggtaaccactattctactctctacttctatgagcccaactttttagataccacctataataagcgagatcatatgttatttggctttctgtgcctggcttattgcacttagcaaaacttcctccaggattatccatgttgtcacaaatggtagattttcttctttcatgtctgaattatattccattgtgtgtgtgtgtgaccacattttcattatccattcatttgttgatggacatttaggttgaatccataccttggctattgtgaacaatgctgcaatgaacacgggagtgcacatatcttttcaatataatgatttcatttctttgggatacatactcagtaatgggattgctggatccatactcaatttaaagatatagaaaacaagccataaatatttatgtcccccaatatccaaaagttaatcaatggccaaatcagcttaatttgtctgttttgtttttactatcaaacttaatacattcaccaatgctctttttcatagttgtagccttttcttgaagattataacgtttagtagtttagattgttatgtagacatgtggtgattaaagtaactcctgcaattaatttaactaattttagttatcatgtactacacttttacatactatttccctcaaaaatgttaaaaagcctttcttaaagcctttttagcagtgccttttatatttattcgtgttactgtttcatcaattgctttagtttggtgacagtttcatgtagttcatttactggattcaagttacagtccagttacttgaggggcccaaaagttaaggacttctgaaagtgcgtgaattgcttctactcactgatgcatcccaaacattcagatcttgttacctgaatcaggggttctattctttaaagttccttggaggatactatcagaatgaaaagactcaaaatagaagtcttccggaatacaatgttgtggttttaaacttaaaagtattgccagtacaacgttagtatctactgaggtggtcacactcattccagcaggtcacatactgagaactgcataggctttgtatggtaggccaaaataactttcagattgagtccatcaattatttttctaaaaaaaaaaaaaaaaaaaaaaaaaaaaacccagagtttttgaaaaacctacttagtcatttggaaaaatactatgacattgaaaatcatattcctggaatccctaaacattattaccaaaaccatcggccacagagctgtcttctactttttccccaaccccactaattccgagtgtatctgttcttaatattcaggttatacttaatattccatcttaatattttattttaaacacgttttatgctaaaaatttacacatatatttataatgttctttctttggggatatgaggattctactgctgacctactgctgaagtactaaaaaatagtacttcagtgtgtacagtaatagggttgagcaatttattcatgtcccagccaatttccaagtatccacacacatttcattggcaaagtattcatatccactcatcagagtttgtaatgtaaactgtttctaaagaatattttctcactctttcagaggagaaaatcagtgtattttaaaacataaagctaataaattccatcacacagaaattaacttcaatagggctgtggtttgaaatatgttgtaatccactgaaggaactcaggtaaaactagtaggttagctaatatttattttttatttttatctttaagggacaagatctctctctggcacccaggctgaagtgcagtggcatgatcatagctcactctaaccttgaattcctgggctcagatgattctcccacctgcacctcctgagtagctgggacaagtgcacaccacgccctgctaattttctttttatttttcgtggagacagggtcttgctatgtttcccaagctggtctagaactcctggcctcaagcaatcctcccgcctcagcctcccaaagtgctgggattacaagtgtgatccatcatgcctggtctagctaacatttttcttttttcttatttcataaaattgagactcactttgcatccatagacttatggaaacattttgaatccagatgccgtagccatttttttgtttgttttggtttgtttttcaatatcaatagaatcttttgtaagcaaaagaaagcaaggacttctttaataatttctgatttttatcgtggcatttcctcactctcctcatgccagcatagtccaaagttgctatttgctcaacattattcaggtacttaaatgtttaaacttgatagtttttaatgcatctataaatttaaacataattctggaaagcttcattttctataattaaaagtgataatctatcttattttaaatgtatttctgtcttgggtatcttttcctaattaaaatttaaactcttattttacaatgagacgttacctcatttatttttcattaaacaaataaaaccagacaatccctgaaaaacctatgaagaattatctttttaaaaatataacaaatccatgtgatgaaaactatctttttacatcaccactacacagaaagtttttcatttttttatgtaatcactattaataaaatcatccatgtaggacaataggcaattatcgttaacacctatagcaaagcatagataaagttgattttttgtttttgtttttgttttttttttaagatctcacttctgttgcccaggctggagtgaagtggtgcgatcttggctcactgcaacctctggctcccggggttaagcgattctcccacctcagcctaccgagtagctgggattacaggggtgtgccaccacacccatctaatttttgtatttttagtagagatggggtttcgctataatggccaggctggtctcgaactcctggcctcaagtgatccccctgccttggcctcccaaagtattgagattacaggtgtgagccactgcgccccaccctgacaaagatgattttactttatcttaacctcatcctcataatggggtttgataattacatttcatattttgatcacttaaaattatttttgttagtagcattagtattttgtacatgaggaaaaggtgctatgtaaccatcaaagtacagttctctttctaacggtaaaagtggttgtgcaaaatgtagcagttaatgtctataaataggagacatagaattctatgtttctctcaagaagaatttctgttaaaatataggaaaaatatatcaattcatatttggtatttatgtagattatgttatagtactcctattttacttttgtaatttaataagggaaaactttttaaaatattcattcagtgagtaactttattgagactctacaatacagtgtaagatttatataccaatactacaaccattttactgacagaaaaataaaaatctagaacagtttcagaaatgctgcctttttatgctgttctccccaaagcaggggtccccaaagcaggggtccccaaaccctgggccccagaccaatcggtccgtgacctgttagaaaccagggggaacagcaggaagtgagccccgggcaagcctgagctctgcctcctgtcagataagcagcagcattacattctcataggagcgagaaccctattgtgacctgcgcatgcgagggatctaggttgtgtgctccttatgagaatttaatgataaatgttgtaatgtgcttgaatcattcccaaaccatctccccagcccaagtctgtgaaaaaattgtcttccacgaaaccagtccctggtgctaaaaaggttggggaccacttccctaaagcttagggggtaggtctaaatattttctcaagactcctctaagtaaacacataaaagcataattttaatgaaagcacttgtatattactgcaaatgtgatacctgaacttttgtttgcttgctttcttgtttgttagcttttgagaatacaattgtttttattacttagagagtatacattgaaggaaattataagaattttcatacttgaaagggacaaaagaatatgcaataggaaacagtaaaaaaaaaaaaaaatcatgtcagggctttcaaacctatctgcagaattcctttcaagtttcagtcctttgggggagccttttagctctctgcaccctctccttctgcttatgtgtaagccttggtgatgcatttaccaaacccttcatatctgtaatcatgaggtagcttttctccttcattgtaaatttagggatagtagaaactgccttatttaacattgtatctcttatataaccttacatgtaccatacatacatagagtctatgggataaataaacgtttatacaaattaaacatgagatggatgaagagataaacggatggatggatgaatggatggatgggtgcatggataaataaataaatggttggatgaatatgcttataattatttctatgtaaaatatttttagtgttaatgacccccaaagtgctcttaaagctccaattacctagttaattgcacatagtacaaaattcatagaggtaaacaaaaaagaacgcataaagaaaattgtttctcctattatgttagctagcctcctagttatcctccttctctcttactgggggtgctggcattgcggttttctgtgtattctttcagatatctgctgtacatacatgcgcatagtcatacacatggccacgtatatcagttcaaatctgtcaggaaggtatgagaacatcaatttcctcataccataaaaaacgcagtatactaccaaacttttgatctttgccaatatgattggtgaaaaactatgaaactatgtcttttagtttgcacttatctactcaggaatgaggatgaacatattttcaaatatttaagagcaatttttgttactttttctctgaattctgttcgttttctttgcaagttataatattccttccaaaattgttttataaccagttgacagatgggaaccagtctctaggtggtatcagaaacagtgttatccagcatattcaaacctaccaacttattcgatttatcactatagctaattgtttgagtagttcatacatttatttacactatcaagaaaaacagtttcaacattcttgaccatatttaaaaatgccttttaggctacaaaggtagattgaagagagaagttccaaacagtaatgaaggcctctattccatcccagggaatttgcaaaggctctttcctggacaaacttgtgctattattttgcatgatggaataattttcatccttcaaatctgtttaattgcacatccaaaaaaacaccttctttgactatgaaatccagactagttctctctccttccctggactctctattttaggtactttctatctgaacatcttgtttatttcttcaataacacttattatattgggtgattatgttattttgtcatttatttgctattccctacaatagattggaagttccatgagagtagtttccttgcatgtcttgtttactgttttatcttcactgcttgatccatagtgtggcatgaagtaaacattcaacaaatatgtgcggaaggaataaatgaacatacacatctaatttctggtgtgtttatcaaaaattcaattgtatacttctggtagactgaatttaattcaattgagtttttcccatgtgtgataagaaggatagggaaagggacagatggaggatgagagggtaggagagaagaagagagaaagagatgggagggaggagaatgtagactctccaaggagcctaggctttttactgcatttatttattcacaatttactgcaaatgaatttcacagacacagaaactgcaagcttagacaccatcattgctctgagacaaatgcatccagagtgtatttgaagttcagatataattgatagataaatgtaaagctgggagaaatttattaaaaatgattggtaactcataactttcaaggaagtgaattgtttaaaaaatgtacataatacttgggttagatactgtgtttcttagttaaaatataataatatatgtatttcaatagatcatatatgccaggagacacctgggcgtattgactattacataatagtgattatctttatccatctagtgtttgattgaggacggaggttgatgtatcaaattaaattaattgagatctaagaatgacatcaataaacaaaatgttaagtttcaatcttcctttttgcatatgtactgctttaatctttcggctattgatcaccagttatgtttgcaaagatcacatttaggctttcctttacagagagatttaacttaccctttaaaccatgagtcagtgcttttagttttggggatttagtttccttaaagccctctgagggaaagaagggtatatatagttatatatctccagagaaattgaatatcaaagtctatataacatgtaatttatcaatgattattaactcctgcacttgcctgtgactgcctgtatttggtgatgaagaaaatatagaaaagtagatgattagaatagggaacctaggaaataggaattggaatgtagataatctacagaacaaatggtatcttcttttatttcaattgtcatttgaaaaactttctttgaagagtaaataaaatataacaaatcgggactgaattcagtagaatagactgaatactactaaaacataaaaaataaaagagctaaaaggtaactttaaggtgtagctttatgttcttacatttatggcatgagtgcaaggaaaggctcaacagttacatgcatccatttactttatagttgaatagtaaaaaataatgcagtgaaaagtaatacttcctagggatgttcttagacatgcaacctgatcaaaaaagtataaaacaggttggatagtatctctggaatctcccattaataccaacaatgccttttcatcaaccaacactatttgccatagtcttctcaattctatctggacttcctgattttgatcttttcaagccaatccttttacacactgctctcagacttagtcatctaaagggtctttgatgatctccattgtcttaagttagaagtcctaagcctggcctacaaggttctctattttttgtcattttcctattttgacttatttcctccactctttgactgtcctacttaaactttaaggcagtctccttagacctggaatgctgtttcccactttctcaacctaccaagcttttgaacgtcctttgggacccagacaaaatctgatctttgccgtgatacatttcattaattctctgaggtggaattagtctccctttcctttgattcttctgtagcacctgtaagaacctgtacaatagcaggtatcatattgcatggtaattattttccaaatgtccttctcctcattccaattatgtgtacttcaagggccaggacattgaatcattgtgtgtatcctatgctggaaatatattaagcttccatagagttctcatgtaaattattgtgaaacatttttaatgctatgaagaaagcattttaaatctgtttaagaatacatgttgaccgggtgcagtggctcatgcctgtaatgccagcactttgggaggccaaggcaggcagatcgcttgagcccaggagttcgagaccagcctggacaacatggtgaaacctcatctctgcaaaacccacaaaaattagctgtgtgtggtggtgggcacctgtaattccagctacttgggaggctgaggtgggaggtttcacttgaggcgggaggcagaggttgcagtgaactgagatcacaccactgcaccatctgggcgacagagtgcgaccttgtcacacacacgaaaaaataatacatgttgaaactttgggaaggttttgaagcaagttttgattaaataggacttagatttcaggagtcagttttatcttcaatgcactcaaatttttcagataataaaattatttaatatacagtcatactaataatatagacccttgcaatagataagttggtgtgtatgcgtatgtccaacagaggattcctacagtcacatatattttagccataaaataggaaatctaaataagcacctttgtcttagacttcagcacaataggtcgaaccttcatttgaatgtgactagggactgccaagtccctactgcctatctctaccaaaggctgatctggaagtgaacccttttctttctttttttttttttttctagcagatgaatgttattgagtttatctgtggtctagtgatgatacctgcagagcagcttcatttttcagagtcattcagaaagctatcataagcttcttccttcttgtcaggcagagcaaatcctggcatgacaggatgtactgggagtctccgatagtgggaactgacaaagatgtgccttcagcactcccacaaagccatattgtctttctggaaatgaggaggatttattcagcaaatctaagtgtaaactaggagacccatcagataaaatccatacaacaaagatcaccaaccattttttcttcttctgaatagagccagaagatgcaatttaccttcttctctttttttccccagaagtgacaatatagagttagagagaaattatagagcggagattttgaaattcagtttcctccccaactaccagttgaaaaagcatagccttaggaaatgttctcatttgatttcctatgttttataacatgttatgtttgtgaatttgtgtgtgatgtgtggtggtggtggttccaaaatatctaagatatatagtaaatgagcaaacaaaaatagtttgtagcttttgatatatcatagttgtacatattttcgtgttacatgttgtattagttcatttttacacagctataaagaactacctgagactgggtgatttataaagaaaagaggtttaattgactcaaagttccacatgactggggaggcctcaggacgctgacaatcttggcagaaggtgaaggggaggcaaggcacatcttacatggtggcaggagctgggggatgtgggggggggggaagtgccacacttttaaaccatcagatctcgtgagaactcactcactatcacaagaaaagtctgagggaaatctgctcccatgatccagtcatctcccaccaggtccctcccctgacacaaggagattactatttggcattagatttgggtggggacacagagccaaagtatatcacatgtaatattttaatcatgtatatactgtataaatgatcaaatcagagtaattgggatatccatcatctcaatccttcctttctttgtgatgggatcattataattattctcttctagctattttgaaatatacaatgaattattgtttattatactaccatatactagaaaaaatgctctttaaacctcatcagaacacttgctaaattgtctttctatatgcttatgacaacagtaaaaaacaaagatcacatgtccaatattactgggctgtgcttggaaaaaaatattttactcttttttaaactttagccaattatatcttcaatagatatcaacactaatatcacatctttaaaaagtttctatgggttttagtaaggtatataaaaccatcaaatatattatccagagagacaatatattgacatttaaaatatgttcttactcatttatggtatcacctactgtcagaggtaaagtaaatttaatgatgtctaaagggattacagttgcttaaattggctagagttttatatgatttatattttcattcttttctggacattggaatcaagtagtaaattttgaaattttatattatatttttacttatcctgtttacagtatcacacctgactcaatttagagtagaaaatatttctagttacccttcgtcagaatataaacatcttttcaaattcatttcagcattttaattgtgttaatagaaatagttcaaaaatatagcataaacctcagcatgttctattttggagagaaggaggacaatgattgttgactctgatggatagtttcccaatgtgaaaagagtaaatttttcttcataataatattttatttcatttcatatggtactctaaaataggcaaaatatacctttacctctcttctgaatactagaagtagaagtaaatgattttattattgacattattaattatactatatttatgttgatatgatgccttacagttcatcaatcattttcatatattttaattcatttggccctaatagctgtgaccacctcccagaatagcccagtcaaaagaggttgaaaagaaaaatcatacaaaatacccatgaagtttaagaatttatggcacttgaaatatttgcccttagacaatgttcttagtatttctgagcctcagtttttaatacatgaataagaatactttaagtattattcttccacataatgggaataagaatacttactccatgaaatgagaataagaagacttactttatgtagctactgagggagtcaagtgaggaacaattactaatgccatgacacagtgtagatgctcaatactcatcattcagtttccccttttgaacttaaggccagaaagaagtgacttcagtggtggtactaaggagagagggggtgatttagccttcgcttaacattcatcagacctcacaccaagccacaggaagcaaatatacaatctctgaaaatagggaaacctacattcaagacaaatcctgtgtgtacctcctccccttcctctcccagaaaagatggctatgtctgaatcacaaaatgtaagcggtcgcctaaaaattcagaaatcaggataaattatattttacctcattttaacaattaaaatcaatgcaaaataattcatatgagcaaaatattaaaattttaagagaatacaagatgtaatcttgcattcgtgccactcatgttctctggcctcatccttatctccacttaaccaccaactgaaggactagaaagttggcaatgacataaagcacagcttcctcatgccatcttcccatgtccccccaactttgggatagtaaacattgcctgaatttataatcctgtaatatttttaaatgttttatcagatacatatgtttcaacaatatttgttccagtttagtgtagcaggtaagactgtgggtttcagagcatttccacctggatttgaattctgtctacactaattactggatatctgaccttgggaatgttactgaagttctctgagcctcagttttctcatccaaaaaaaaaatggggacaataatagtaaatatgtcatagggctattgtgaacatatgtgagaacattaaaaatatttactgtatgacacaaaatgttttagtttgtttttatatttaaatgttattaaaaagatatttgggactcatattttcctcatgcatcatcccatccctagaatttatcttgattgttttgtgtagcagtcgtttctttgactactatgtaatcaggttaactgtccattttcctgccagagggcatttgggctgctcgaagatttttcgtttattgtgttattttgggcagtgctgctaggaacattctcctcatgtttccttttgcaaatgcctctctgtttttgatgttgcagatggattttaccttgccatggcatgaaatccaaaggctgtacccacagattccgatatttatctcttgcttgtccacacctagtaataaactttagccaaagcaaactgttgcttgttactatgagcctaaagtcgctgtgctggtccctcctgaatccttttctatgagtcgcttagtactcttgctctcaagctctggtctgtaccgagctgacagctttttttatttctaggactttattgctgttttaaagtctttccactctgaatctgtacctattcaccccagagttagttgcatttctctgtgtctctaacctgagggtcatgagtctgactttgctcagtgaaggcaaatattttcttcctctgcagtctgtgttcattttgataatgatgcttgatggggggactaagcatccccctgagaggaaagaatctcgtttggattgtaatttgtcacagtttgtcttagtttggatttctttaaaagctaagcctgaggcgaggactagagagcaactagctcatttggtagctgatcacagggagcacaagtgggaggcaggggaagtaaggaaaaacgggggaaaacaatagtgagtgtattattcagctggctactgcagtgggaaactgttgttcaatcctgtgaagacccctctgaggaatgctgtagaatgtactcataattgtccctctgaagaataagaggctggggaatatgtctctggttcctgtgcctcattaattatttctcagggacatcaggtcccctcctgtgtgttggatgagtgagtttctataactttggacaaagtcgtgaggctgaaacacagagaagcagtgggtgcttgacctggtgggctgttagcatgcccgagactctccattacagggctgatcaagccagaggtaaaccaacagagtgggcagtgtctgctacacagttccaactggatttcccaattacctagtgctatggtcttctttgacaacgtgtctcaagaaggtaacctgtagctctagcccactgctactgaatgtttcatacctggtatcatgtggattataactgtagtatttcatttttcaggtattgtagtatcgaaaagccctatagcctgttttccttagtataaattttgattaaattatgcaagtccactttaaattcacagtttgatgttatgtacttaggaggcactcaataaatagttcttaaagcaataatttttaaatgactttttgtattatgtagacacatattaactataatagagcccttcggcaggaaaactgtttcttcaaagttgcaaagtgactgacaacgatatatataactagaagcttcaagaaaaatgttaccaggggccacttttaaactagggggaaaatcgtttttcacaataagctatcccatctcctccctactgaagcctctgatctgctatgattattaaaccctcatcttttagtgcaagaaacccagcaagctgaaagggaaatgcttttcagatttaaaaaacaaaaacaaaaacaaaaataaacttaatttcttttaggttgatgttgttatactaacttgccaatcagttaaacatgtatctgtcttttaaaaatatcttattacataagaacaaaagattttaagacatacagtttcaatcataaccaaatgtgtttattacttcgaattttccacagtaacttgaagccatctatgtacccatctccaattccatcgcttccccactaccaccagagataacggtggtcgtgaaatttgctttgttttatagtcttgctacatatatatgtattactaaaagagaaatagtcttgctctgcatgcttttgaacttcgtatagttggaatcatattgcatttattcttctgtgactgtttctttcaatcagcattatgttgctaagattcatccatgtctgtgactgcagcattatgtcatattccgtcatagaaataacccacaatttatttatgcatactactgttgatggatactagggtcgtttccagttttaattcttttcctattacaaacaaggttccttgtatacatgtaggagtgggattgctgggtcacagggcccatgtatgtgccctctggtatactctttggctcctttacactgctctactgtgtaccactgggagactgacctttgtagactgtgtgtgccaggcttccatttccaggtgacttccagctctctttggctgatggtgaaggattggaaactcagggaagacacaagagtgcttctcttcctctctttgtgtttcaggcagtatctttggcaacagctgcatatgctttgatgtcccccctccaaccagataggcccactatagctgcagcttccaatgaatgatctcataacctcattcactgaattcatgcaccctgccttcttctttcctcctcctccccattccttctcctcttcctcctccccatcctcctccttctctctctctctctctctctctctctccccttctctcccactcttcttctctcctctcccttcctctccctgtactttaagggtaatagtggcttcctgtggttgctaaactctgagtcactttgtcctccacagcttgtcaactctgttcttctctcatttgtttcaattctataatttaagctttctgatttaaatatcaaatgactttttgtgtctgcttagattctgactgacatgatgtatttctaagtttccaagattatgccaaattatttttaaaattggttacaccaatttaaattctcacgaacttaaaaattctgcttgctcccaaattctaacacttgacaatgtcaaacttaacttttggctactctgttgagtataaaattgtttctagctgtggatttactttgaattgcattaatgaaaaatgagtttgggcattttttcatggttccattggcaagttttaaatgcagacaattgtttagaatacattatttttatttaataaaactcattattaaatgtatattcctttaaggctgtactttgatttagtgtaagtagtacacaatttacctcagttttccgttttatgtattcactcatttaatttagcagatatgaattaagttctacaatatactatacagagtttaatgtgaaagtaagaaatcagaacatgttatggctaggataacttgggagcacagccttttgaaactggtttagtgttaggatacacatttttgtgtttacctctctttcccaccgccagtttcaccatcattcataagatcaatgactgtggtacattacaaatataatgtgaaattgtttacaagatttagtattgttcaatcattttgcaggcactatcatggaccttcagtgtcaataaaggattcagaggttccagaaaattctaggctatatcatgccttgagaagtcctatctaataaatatatagaccacttttagagtgtaaaggaattcgtaaaatgtgtcagcttaaaatattgaaatagcgagggtgacttttcctttccaaactgttgatgaagactgcagacagggataaacattagctctgtgtggacaggatagtgtctgttgtctgagattctggtcatactggtttaatacccataattgaaagagctctaagacatggctttgtggagaaagaaagatactacttgagagaaagcaagttcatatttccttttactaataagtgttcagattcctaaaatactgtaacagtaaaaagatattttgaaactttctaagaaagtgtgttctagggcggggcgcggtggctcactcctgtaatcccagcactttggggggccgaggcaggcggatcacgaggtcaggatttcgagaccagcctggccaacatagtgaaaccccgtctctactaaaaatgcacacacagaaaaattagccaggcatggcggcgggcacctggaatcccagctactcaggaggctgaggcaggagaatcgcttggcaggagaattgggaggcggaggttgcagtgagcccagatcacaccattgcactccagcccgggtgacagtgtgagactctatctaaaaaaaataaaagaaaaagaaattgcattctaggggtgaacatccacatgtacctgggatcaatccttccacagtcatatcttcacatcataattctaaccctaaatcatcaagaaaatattatgttagacataccatacataagaagggaaagagagctgtcctacataatcattttcatgtaaacctttcatccagaagttgaggtgttctgtcatccaaaggagtagctctcagctgtctggaaaacctttttgttcagaaggacatttgttgtgctttggtttaccttgggttttattgtgccgcgtgtgtgtgtgtgcaattctcattctattaaattattgtgtgattttgatacatttatgtcagggattagaaattttagaaatagattatttctggttttctgatcaatgtgtcctgtctatgtattttgtctttgtgcaaaggaataagactaaaacacaagttatatgcctgagtctacaactgagtgttgtaaaccaaaattccaaatgaaagaaagatatggggtggatggcaggattagagaattgaaagagtgaagaacaaaaggcttgcagacatcagtaaaatatgctttcttagttaaaaatagtaagaatgttttggaatattttacattaatttcgtttcccactttttctttacttttgcacaattaatgatttagtttttgagtttcaaatatttggccaagcttatctactgattgaattcaatttcttactggatgtgtgtactgcttttttgttgcattcatggcataaattttgtggacgcatttctacaaaaaccgtggattcagcatgttgcagagtactatggcaagaaaactgagtaacagactaagctgagacttggtagaaaatatctgttctcctacaaggcttgactctctactgttacttcaagaaaatattatgttaactatatgtgttatacttaagaaggcagaaggatactcactcctctgacgtggcgagatactcctcattacccccacggaaatactatctagattgtgaactcatccatagaatgactacatatgattcattttgtgatttccctaatatgtattgagtttaaactacattgaattccctggagtttgactagaaggttgattatccagtagagtttcttgtaagaaattcttatagcagtgaactattctttatggcagataaatcctacctgtgtatactgattttctttcttagtaccatagttatactcaggttactttttttttttttttttttttttgctcatatagacaagactacataatcctttttagaaagggccaatatcctatttggaataaaaacaaaacagttagatggtaccagggtcaccttaaattaacttatcagactatcaaccaaatcgaaatatgatttcagatgtaattaacccatttgcctagtgagatgcaaaggtgtgaggatttcttgaacacatctttctcttatgtagcaaatatcaacctcctgataccttttgtagtcagttcacataccatgacaatacatcctaaattttcaggtgtgatctaaccagcataggttcacataattggcatgacacggaatttttaaaatatcaactacctcaggaactttattcatgtgaatctggaagatcctttttggtatttgagccctttcatagattcagatgtcaaagtatttttagaatgggtctgtaaggcatcattattttgtaattataatcttattgattgacagcaaatgctgtgttccatgaaaatgttgcattgaagtgatcccggttagtgctaaagacagactgcttagatctaaagtctcatgagaagaaagaaagaacttaaaatcattttaaattcaccaatatgacgatacaggatctctcataaaatgctgaaaggttgtttttgctgccagacttttagcacttccgttttacgttcaaatgttgtaaaggttgattactcataagttaaaatgtttggtgcaaaatgtactttaaaaatattttcagtgttttttggaaattgtagacatttgattttgaaaagtaggccagaaatttggaagactacaagccatatgatggctgatatttcccatggaaaatataatatgcagctgtgctctgctgcatggtagaacaggagattaaaatatgagaaattataataccgtttgatgatgatattaatgtcactgaatcaaataaagtatgtgatatatcataagttaatagaacaacacttaattattgattagagcctacatcacattttaaattatcggcatgtttggtcttgcaaagggtcaagggtgactcgtagcaacagaactattctcctttcaaaaagttagcagaaagttaatatcaaattctatgaggtagagagggatttgggctgaggtaggtcaggaggaacgtaaagagatgtgtcatgtgtagatttgtgagctgtgggcacctgattttgtgtttaacagtatttacgaccaagataagtgaatgaagagctatgttcttatgaaccttaagtttattttgctaaaataagtaagaaaattcaaattcaaattaagctatatagtcttgcaaatttcaggtctctgaggggtgtgcattaataagtattcaaaagtattttgtcatttaattactattatatgaatttttatgtaattgaattattcttgaatgttgagaaactgtctttactaggctaaaaattcccttagtgatctcgttacccaattcctttgtgttccactctcagtgtctgaattgtcaccaatatgtggagtccaaattatgaaatacaaagctttaccagaattctgatgattttgaaggaagaaaattacagcaaattttgatcaattctctcctattagtgattaattcaatgaaccgcttgaatttcttatttcctcgtagaactgtatgtacatgaaggatagatacaatatttagtacaatctatagtgagatatgaagggaaggagattatgagaaaagaataaaactttattataaaaatgcttgttcataaagatttgacacaaaatcaatatgataagttttcagaaaatcaaacaatgaatttcgtatgaaacctcacattggcaaagcagttatgtgaataccaatattttttaaatctaaaacaaagcattttgaagtagtttcatgaataatgtactgaacctgtttcacgcaatgaaatgaacatcacagtgagaaaattattccacaattgtaaagttaagtgaagcttgcattataaggccaataatactcaatagggtattttctcatgaatttacactatagaatgtttttattctggaatttggatgatatcatagtcattcaacaaatacagagactaagtgatttttaaaatctttcaggaaattagttctttaatttcatctacatgtatgtaaaataaccaaacctatgtcttatgcatataatgtcattctaatatattgttcatgatcataatatttatatagaatccattttgcttggccgattgatttggcttggcctacaaattagtacagtccctctcaactttgacacttctgtgtaccatcagctccttcctggagtactgaaatagcatcctaactgctctctctcatgtagtcttgaccccatctataaatcctaatttcagcatttggagcaaccttttagaaagatcaattaaatcatctcacctcttcattaaaacgcctctcattctaccaagagtaaattccaaaccttttaaccttgacctacataactggaccatgcctccctcgcccatttcaattcagctttgctcttgtagctccaggcaagctagctctgtcttagttcttgcatgtaataagctttcaagtccctcggtgtctacttatttactgttccctctgtattagtccattctggcattgctgtaaagaaatacctgacactggataatttataaagaaaagacgtttagttggttcacggttctgcaggctgttcaggaagcatagcagcttctgcttctggggcggcctcaggaagcttctaatcatggcagaaggcagacggggagcgaggtgactcagacggtgggagcaagggcaagagagacagcaagtggggaggtgctgcacacttttaaacaaccagatctcgtgagagcccactatcgcgagaacagcatcaaggggatggtgctacaccattaatgagaaacaccgtgatccaatcacctgccaccaggccccacctctaacattagggattacaattcaacatgagatttcgtggggacatgaatttaaaccatatcactatctgactggaatgtgctttgctcctgcttctacttccgttttctgagcaatcagacagttattcattaactcattcattcattcactcactcatttgttcatttatgtattaaattattcagtgattctcaactctgggtggttttgccgtccaggggttatttcaccatgtccggagagattcctagtggcataactaaaagaagagatgtttgctactggtgtctagtgggtagagaccagggatgttgctaaacatgtaataatgttcaggtcaacccaccataataaagaatcatcttgtgcaaaatctcagtagcaccaagattgagaatctctgcaatacgtcaacaacccttctaggtgccaggaatatgacagtgaaccaaatgaatatggtctaaactttcacaaactaatccattaaggagaagatagtcaataagctggctaacaaacaattaaatgtatactttcaaattatgttgggtgctctcatggacaaggggacaagagagtggccagtgaaacctaatttagagcaggtggtgttgggggaggtggtgtttatgctaagacccaaagaatgaaagaaagactcagccccaacttatatatatagtaaacatttattgaatatcaatagcaaaaagttgcatttttctcaaccatgtctttttatggtaactggaaattgttcaaattattttttagaatcttttaatcatagattctttgctaaggggattagtctagcatttttctcttgtgagcaattaagttctcaccaagttagtgaatcctatgtcttatgtacttcctacttattactatgaaattatctaaaaaatgctcatagggttcctaatgtagttgaaaagcaaactgttgctgcatctctaatcagtaacaaaacttgtatttctgtcgcaaaataatgtaaaattttatagtactttttacatatttatttaaaacaattttaagtaagattgtttctttgtggaaggtcatatggtcccaatatagggatgtgtacagaaatacatatatacatacaacaacacaatgttaaacctagcaaaagagtggagtctctttcttttatttttcttactttttgagcaacgagacaagcaacatattatgcctagtcacttgaatcatacaccattaaaacattatgggctgagtgcagtggctcatgcctgtaatcccagcactttggaaggccaaggcaggtggattacctgaggtcaggagttcaagaccagcctggccaacatggtgaaaccctgtctctaccaaaaatacaaaaattagccgggcgtgtggtggtggatgcctgtaatcccagctacttgggaggctgaggcaggagaattgcttgagcccgggaggcggaggttgcagtgagcagagatccgccattgcactccagcctgggtgacagagcgagactccatctccaaaaaaagaaaagaaaatatgaaaagaaccatttttaatgtcaactactgctttgatgctaatgtctgtcagttcagtgtctatgacttaccctttattctgctcaaaaccttcttgaattttccatttgaatatcccacaggctcttgaccccacttatccaaaattaaacctatcttcctctctactacacctcttcttataatctttctcttgctatttctaaacatttagtgggccaaataaataccctaggagacatgacttgaaaggggtatgaagtttagataatgttcggcttcttgatctgatactggttaaatgggtgcattacatttgtgaaaacttattgagtcacttatgacttacagattttctctatatattttatattttaagaaaaaagattacatataaattctagaagccaagctacacctttccctcttattcatccagcacatttactgagacagctagattttcataatgactgtccattgttgaatatttgctatatctttgatattgttatccattattaacttccttacctggtttgacagttgaaaatttctgtggtgcagctattattatttccatttcacatatgagcaaaaagagacttagagtggttaagtaacttgtctaagttcacacaacaacaaagtggcaggagtagagtttgaattcgagtcaatatttataatcactatgatatcttgcttctcgtgttccagtcgcattaaaactatgaatgccactcccactccttatccatccttactacctggcttcactttagatcttcaggtcttctttcctatattataatgataatatcataagaaatccagtgcagtttagtctattccaaaatcagtctaaatactgccaggattagtgttcattccacaatataaatctgattgtgtagtttacttaaaatccattaacacagccgttagcaaccttagctacatgtgaaaatcaccaggctccacccaagataaattaaatcagaatctctgggtatgagggactgggagtgagcattttaagaaagctccctgggtaactgtaatgctcagctaggcttggaaaccaatgctttaacgtttccctacagcttttattataaaaataaacccctcagcattgcacaaaatgccctttgtaatttggtttttgccttcctctacctcgcctcctctgctgtaattcccttcttctcccactttttccccaccctacctacatacatttcattgcaattattcaaaagtctttgtttcttctgaagagttatgatttttataccatacccttacacataccagtcttcccctctaaatgcttagttacattatctttgtacttaatccttttagttgctgataataaatgaaaatttctttttagtttctttttttttttttttttttttgagactgagtctcactctgtcgcccaggctgggctgcaacctgggctgcaacctccgcctcccgggttcaagggattctcttgcctcagcctcctgagtagctgggactacaggcatgagccaccaagcccagctaatttttgtatttttagtagagatggggtttcatcatgttggccaggctggtctcaaactcctgacctcgggtgatccacccgccttggcctcccaaagtgctgggattacaggtgtgaaccaccgcacctggccaaatttctttatagtttcttgacttgtttttaatttagaaaatttcccacgtatatagacaccatacaatttataatgtaaagctgttttcctatatcaatcatgttttaccttttttctctttctcctatatatgctgcttcctggaagatctaggagctgacaagtgtctttttatcttgctttgcaaatctaatcttttgccatttctttttatagaaatgaaagcttgtatcatgcatactaaagatggcttcttctttgggctgtagggccatttaatgagttatattgaactgaatgctttataagagttcaaattagtacattgggatactcctatgccagggatggattaatatatctgtccacatatatacacaaaaatgtgtgttgctaatttccaaattagagaatacttattttgaattatcagtatctatgacatattttgcatgtggtatatatttggttaattaaactgagttaccacttgttttatcaaaatttggtgtctttctaaatatatcatgaatatttttcttctaatgcacctcgctttctgctggaactatagaaacactttgtaaatttttacttgtgaccactcgaacatttacaggacattttacctgaaaattttttctgagtcagtgaagaaaatgtccatgtttctgcgtgtgtgtgtgtgtgtgtgtgtgtgtgtgtgtgtgtgtttgtgtgtgtgtgatgcttgcttatgaggaatttattttggctatggttctttattttgctattgcactcttaacattcgtatgatatgtattattaccctataaatacttacacaatatattcttacaaaaattaatacaaagattggccaaaatgtaatagcatatgtttttgtaaatagaatatccatatacagtcataataaaactgaagagcgattttatacttttccataaagccaaagattaagggtgtaatcactgcttataatttactaggaaactataaaacagataaaagtagatgaaaggatattacaaatatctcaataagtcgtcctccgcaactgaccccttgctttacacatgttcagacactctatactaaactctgtttatttttctattttataattttctatatgatcgtaattcagcgttttcctataatattattagtagtgctaccaacagatattacattttatgaaaaattttaaaaagggcacatgttgcataaaactaggttttgaaacagctgcttataatgctgatatttagcacatgactaggtggaatatggactttttaatgaatattttttcaaagttaggtaatttctcatcagtcagtttcaaaagcaaagttaaaatttgtgtttcaaaaaactgggtatgtttgaaaattgtatttaataatggattttgagagttctcaatagcaaattgcttggctgactgtagtttaagaagtaataattttgaagagaagttgaatgcaggtactttcaaagtgttgaaatttttaaagaagaaaattaaccttttcagactgtacacttgttcatcttttatattcttttccctttaaaaaagaattgtagtaagaagggagattaccttctgtcattgatacaaattttccacagtataaatgctgtttatcacatttgtataatatacacttcctatcaattttaaaaattacatgttactactatttaactctgacttaattattttaaatataaaataattcattcttttataaataatcaaaactatagttttacttttctttcaaaatataccactgactacattacagattagattttttttagtataccaaacatattttcatcttttggagttattggaagagtagctgcttactgccttacattttagatttctctatataacaagcattttcatcattttggcttattcgagtaattcttaataaataataatacaatatttacaaatgagatgtcatttgcaattttaacacttcataattttaacaaaatatctttactttgagttttttactttccttttggtgtgacattttgacctccaatgtgatcttcatttaaaggaaatatcaacgaaaattccttttttttcatttgctatagatgtacatataagatttacatgtgtaaggaatatagagcaataatgaattgagctattcctcataatcacttcacttaagaaatagggggctgggtgtggtggcttgtgcttgtaatcccagagttttgggaggctgaggtggtaggattgcttgtgtccaggagtttgagtccagcctaaccaacatatcaagacattaagtctatgaaaaaattaaaaaattatctgggcatagtggcatgcacctatagtcctagctactcaggaggctgaggcagttgaatggcttgagcccagaaattcaaggttagactgagagctatgatagtgccactaaacttcagcctgggaaacagagtgagggcccttctcttaaagaaaaattgactagaatatgactaatactctagaagccctcctccacatgccacccttcccaaatgcaccactattctctcttcccaattttcatttttgtatttattattcctattcataccaacacaattttaccagatgtgtatgtattttcagcaaatatttttagtttattatgcacttaattgacactatggaagaacagcttttaagatattattccaacttagggaattttaaggaaataagacctttgtatataaaaagttaaataggaataccgatttgcttttgattagtgttaaatcacataagtttaaatttgtaggagatcatagagatcagaaagcccagtggttcacaaactttcttttttttatcaacaaaacctcttttaaaaatatatagcataaggaagacggaaccataaaactgaaattacagcagctcaactgaattgtgagtttcaactgaactcaatttcaaacccacaaataagtcaaactcttactttactgagaatatatttggaccacacagagtttaaaaaacatgtttaaatttatttagcttatttataccagaaccaatataagaatccataacattctgcattagaattaagtacaaacactttttctttctttctttttctttttctttcttttttttttttttttgagacggagtcttgctctgttgtccaggctggagtgcagtgacgcgatctcggctcactgcaacctctgcctcccaggttcaagtgattcttctgcctcagcctcctgagtagctgggactacaggcacgtgccaccacgaccagctaatttttgtatttttagtagcgacggggtttcaccatgttggtcaggatggtctcgatctcttgatctcgtgatccgcccgcctcagcctcccaaagtgctgtgattgcaggcgtgagccaccgcacccggccgtagaattaagtacaaacactttctatgatattatactaaattaaaaacaggaactcaaaatgatacaaactgaactgaaataaaataaaataatacagtgaatggagtccacaattaaaatacctgcaaggacctgaaagggaatggaaataggtgaagcaaagatctaaatgcatacggacattgtgtaaattggaaagaatactggcaaatggcacgcctgtgcccagtctaaaatgggcaactgctaatcaattcagtctagcagtgtccatgtcagaatgtagagctatttttggccatatattttatttttcaagaggaacttaagaatctggagttgtatgtaaaacatcccagtgcactatatatttgcctcataagttgagcacttttttttatgtgtgcatgttgtctactggtgaatcccaagcacttggaacagtgcctgatatatagtaggcagtgatgtatatttggtgggtaactggaaaaaggttttccaattaaaaattctgtgcaagcctgaggtaggagttgggcaggacttatttcccattcccagaggataaagtgaagaaactggcaggtaccagcaggcagcgaccaacggaagtgagaaaaacagcagaaaccagcagatggcaacaaaagtgatccccagcagccctcattgcatattagcagaagccactcccaccagcaccatgacagtttacaaaggacatggcaataacccagaagttaccacccctttcctagaaagttctaaataacctgtctctcaatttgcattaatctgccacttaatttacatgtaattgaaagtgggtataaatggatataaatacagtagccagcagcccataccctgccaactttggaggcactgcctatgagttgtccctatttcacaaagcgcagtaatgttcactaaaacatagctgtttaacgccactggctcgcccttgaattctttcctaggcaaagccaagaatcctcccaggccaagccctgattttggggcttaacctgtcctgtatcaaactagccaaatgtatctcaggcctgaattagatcaatggctaccagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagattctcattacgtttccatttgctgcggaaagtggagaaaagttcagagggggaagactaattaaaaaaatggttgtctactaatccattgaactaaggcttcttaacagtcatgctcttcttaatagtatgaacacacattttgtattgattgcagagaataaagaaaaagaaatgacttgttttgaacttcaaaatggaaaaaatgaatacaaaatccagataagcctttgggcataccaactttttcgacttgtattatataacaacagttggcaaatgatttcaagttgctaaagcatagaaaatgatatttatttgatgaaagctaataaatcagacagaacaattaatggataatttggattgaacaagtatgaaagattccaccaataagaaccctcctacctaaaactatgaggtttttaaatgaaagactctcctaatgtcatagattttctctacctgtgctttatctgaaaataaaaatcacagcttttcccttcacctcttcattctctactcctccttatatttcccctttccttcttccttccttctccttcctttactctttgttctttttattcctgtttgttctgattacctgtgatgttttctaaaaacattaaaattttggtcaccattaatattttttacaatgaattaagaaatttatctcagaaactggatttgaaccaaagccttgttttgaacttctaataagtagactgaggaacaagcacgattttaagggcatatttaataggcaaaataaaaaaaacgcataaaatgcccagtcgttgatgaaaaaaatatatttttgtaattgctgttattcaggtgcttgaaggcccatgttaaagtatcactggagaagataaaaagcatacttcctcaatgtgaaaaccctcaaaagaaagggctataaacactttgtcctgaatatttgttgtttcaattgctgacgtttaacttttcatctgacagcaattcaagttctgcgtaccacagtgttgttgaatctttgaatctgaaaaatattttccttgcagctgtgataataatgtatctcctgataatgcatttaatgtggcaaagacacttttcttaaacacagtgaaaactaagtgttcattttgtcattgtaaaatgagacatgtttagttgctccaaattttaacttgggtaaccttgagacatagttgcacatttaacatcctatattttgcttgtcttgcagtcaagtgaattatcttagttactggagtgttacgtgacaccaattgttttgttaccactgctttaaaaatagctctatccctagaccccatcagtagtgtgtcttttagggccccgatttttttctaatctataggttagccctcaaggcaacgtggcctctttctgtttacttctcattattcctgtaattccaattctacatgtgactctttgctttattttaaaacagttgtgcattgctgatgagccttgaagtcaccaggggtggctggtgtcaatagtgagtctgtacatggctatttttatccataaagcagtttactttctgtatgatgaaaggcgttaaagtaaaacctgcctcctattataccctaggggtgtaatcaagagggatttgatcatagcataccaattaagcaggctacagcagactgctctgggttgtactaaggagtagggtgttctccacagatttttgaaccctttattgcaaaagcatcagggcacagcacatctaattcttttcatcgcacagctgtgtacataaacctctgtatacagtttctgctcagaggctgtgctcttagatttaatttttcttataagtcattacagccgtgatcattcatttaaacctcggcaagataagcattactagttcccagtaaactagatgatctcttcctctagactgtattttctcttatgaacaattataagattacaagactagcaatgttgcttatttacactacactacacacacacacacacacacacacacacacacgttcattccaagccagcagccagctcagcatccttgaaagctctcaacctcagccgaatatataaatatcagaattctctctaccaccctcaattagaaaatgttccagttctgcttttaaacttccactccaattcttcttgctaaggcctggaagcctcaaggtttcttgtattgccttatatacacctggattattcctctctgttgaaaactatgtcccattggaatgggagtgtctgaccagctggtgcccaagaatgctctcagaaaacgatcttccacaagccagagccaaaacccaaacccttgacccttatcaaccttgacgcccaaaactccaggtgtggattagcacagtaacccgcaaacccactcctacacgaaggaagatttttctagaacaactacagctctccttttatatttttgggtaattcagttatgatgaactgaaccagaagtataaagtatttgctcagttcagttcttaatctttgtcatggtattacaatactaaaccacttgctttgtcactttcatatagctcataaaagaaaatattactgtataaaatagattctgtagtccttcacttgttgttatggactgactattcgtgtttgccccaaattcatatgctgaagccctaacccccaatgggacgatatttggagatggaacctttgggaattaattagggtaagataagcacatgcaggtggggctctgatccggtggcccgtgtaaagaaaacaccagagagcttgctcttgctttgccatgtgaggacacaggagaaggttgttgtttacatatcaggaggagagccctctccagaacttgaacacgctggaacactgacctcggacttaaagcctccagaactgtgagaaaataaatttctgttgtttaagctgcccagtctatggtatcttgttacagcaggctgaaatgagtaagacacttgtattgtccctgcggttgacatctgactctgtaaaaacacccatgcatacacacacgtacacacaaaacaacaacataaccagtaagataggtaatcaagtatatggtaaatgcacctgattgcaataatgtgcgcatacccttagaatgaccctgtactgcagacacacctgaatgtgttttccgagctacggaatctgggagtagcccagcaagagagcccttccttgtctatgaggaacatctgagccccaagtgcatcccgtggaacacgggccatacatacagcggattgaggccccgagttttgggttggatgaaggttgccaggtgaacgtcattaagggcagagggttaagtaaaaatgctatataaactgcatgctgcccgcaagcagcgttggtttgcccgctcatcccaccgccgccatcactaccactgtgctgcgaggctatcttgtccagtctgccaccactggatcgtttctacaggtaaggcacttctcctgtccagcccaccactactgaattccctcccctgtatgtaaacctctaataaaacccaatgcctcgtttgctggctatgggtttcttcctcagtctcttgaacctgatgccttcgctattgagggttataggggttcagtacaacatcatgatgtgaacaaacgcgtttatttgggcagatgtattggtcagctctcaaaacaataatatcaagtaataatcattacctccaacttaatggttttaaatagcattaattctcatggtcatgcggggtttggctgacctaagttgatctagatttggttctgcatcaggctggtagttgctaggcttggctttcagcggcaggtttggtttggatttctttgatgtgtcacgtccagaggcacacactggaatggcaccggccacccagtgcatgttttcataggttgtcactagatagcaagcccaaacatgccagcccatctcaaggctctgctcctgtcatgttttcttaacaccccgttgaccaaaggctatcacatttcccaccataggctagatatgccatcctattaagtaggaatgagaaagtggggaccaataaatcaacctacagtaggaaaagtaggggattatttagtagcacaaacagatgagtttcagtgggcttgctgcttttttgtggatatggaagaaatacctaaaaaaaaaaatttccagctccactacaatatttaagaaaaaacttaggtgtgttcatagtttactactttgcttaataaccccactgtttatcacagcaaatttaatcacctctgaggggttttaatggctttgataagacaaagagtaaattactgaggaggaagacggtcactttcacatcctgagagatgctaactgtgcaaggtaattcacatatatcttgtaaacatgtttgcaaacatatataggagataggtggtattctcattttttaaggaaagaaatggaagacatgagagaatgagtaatatgtttaagaggacacagctggaaactggtataatctggctctaaatacgggcttttgtgttacattgaacagagataaattcagcttatgttaaggaagcatggggtaaaaaggtcaagaaactgaacaactgaataaccaaataagtaggcgaaaccatttggttactcagttgtctgaccaaccgaataatcaaaacaaaaatgtcacattagaaaactacgatcagtgtaattttatgaataattgaactattgagaccatagtgtagcagctgatctatcacgtcatgggattccatcattcattctcatgaattaactactctcagtccttgcttttagcattacctctactccctaatgatacatgatttttactctaacataaacttcccaggagaaaatgtctgataaatatcataaaatcatgaaaatatctgataaagtcatcatcctgcatcatgtgtgggagacttaagtttgtaactcttcccattcctttaagttggttttcagccttgcttacacgatcattgtggccagagagacagaatgtgccaagcgtgtaggcctgagctgggaaacaatgtcaataagtaatacagtataggggatgagaagtttgccaaataatacttggtgtgtaatgttatgaaagaaagggggcattagaggccgggtggctcacgcctgtaatcccagcacttcgggaggctgaggcgggtggatcacgaggtctaagagatcaagaccatcctggccaacatggtgaaaccccgtctctactacaaatacaaaaaaaaattagccgggtgtggtggcaggtgcctgtaatcccagctatttgggaggccgaggcatgacaatcgcttgaacccaggaggcagaggttgcagtgagccgagatcgcaccgttgcgctccagcctgggcaaaaagagtagaactctgtctcaaagaaacaaaaaacaaaaaacgaaaacaaacaaaacaacatggcgtggggggcatcagaaacacacaatggtacagatttaaaagctcctcgggtgatgctaatgtgtagccagggctgaaaacctaaaagaagaatgtgcagtaatgttgccagtactggaaggaagtgtctgagttttgtctagtgactgacagaaggctatgaaactgtaacagttgtaaggggttgagggaaagccgaggccagatcatgtggatcatgtgcaaattgtaggtaaaatgtaaagctgtgagttctgtggcctcactgaggaagcatttctctgcttttcaggaagtaacttggagttgagtgctctatgatttccaagttgtcagctaacacattgaataactgatgaattatggttctgtggccttcatttctgtgtcacgtggctatactgttcattggcatatgcaggcagtaacccccaaactatgacgcgagaggatggcaggattccaggtctgaagagaaaaaatgattaggctggggaagaatgatttgaggaacctcaaatcagactatggcagcaactactaggtgtagggcttcatgccatccagccttggagttgtcagttttctattaatctttgctaacaataaaatactaatgggtacataatgtagtgatttacagatgatagactctccttatgttttcattttgtctcaacagagtccagcatatttcatccaaattttactgatcagagaattgaggtacagacagaccatgaaggtcatgacagttggaaagtgttggagtagaataaggaagcctgatttttctcatttgtcctacatcgctttattagattgtcttctccagccttacctccccgccttataattcttgattttcatgaaacctattaaagggaaagaaaaggaaaactagaaaatttaatttagatcacttttaaaaatcactttgcatcttggactgttgtcataagttataggattaaatcctaatgattctaatgttgttaggccatcttaatttatatgatccacttacctctcagtcttctctcactggctcactcacctgccctctgtatatgaggggattgagaaaagtctgtttttcattatgtgtagatacacagactggtgtgtatgtagcaggaataaatgttcgcaaaactcagatgtggaagaagtaactctgaatttttgccctatttttgaactgtactccaggccagtgctgtccaaaagaaatataagctatatatgtaatttaaactttttgagtagccactttaaaaagtgaaaataaacaggtgacattaatgttttatttagctaaaatatttcaacatgtaatcaaaaaagacttaatgagacattttacgttagtgaaaagaatgtactaaatcattaaggttggaggatattttacatttacagcacatctgaattcagttgccatattttcatgggttaaagtaaacttgttctcccaaaccaatgaagttatggttaatggaagaatattaaaaactgtttgttttcaatataaataaaattgaagcaaaaataaagcaaaatgaaaatttggcttcctcagttatgctagtcccatttcaaatgttcagtagccacatataactagtggctatcttactggacaacataaccccagatcatgataaaacgttctgatttcccgaatttcttttttttagacaatctgggatgtttcgccttcttaccaaagaaacaaaaaggtgctggtactttttgtttgcttgtttttcagcagttgccattgaaatgtgtttcttttggagttggataggaaaaacctagattcttcctccaaggtgtagtctcaactgtgccccaggcatcactgtttatgatggattaagggtgtggcttttcccagataatgagtccccctcccccaccccccacaggccttaatatctacagctcctgtcaatagactggcctttccttccccgcgaaaagtttgagtcctttaagaatctaggtctaaggttaatttcaacgaaaggtttattttctctttctgcgaggacctatggaactacccagaacatataaagcagtccacaaggctcttcaacagcttcgtaaccgggcactgctagttcagaaactcactgacttctgaatgtccatttcacatttgcaggctgcttctctgagtcctgagctcttgtctcaagatgacttggctcttaattgttgtctgatttattaccggtttgctttgcagtttaggtgctggacaatgattcttagaaatccccacataaggatctacatgcagtggcagtgaatctcaataactgccttttcttgaatctgaacttaatttatatataaagcctactttccggtagatcctgcatatttcatctcagccaatttaggactgagatgccccccctttctctggggttttgtcttaaatttctggaggggacctgattgtcacgcccctccgagtgaagagaccaccaaacaggctttgtgtgagcaacaaggctgtttatttcacctgggtgcaggtgggctgagtctgaaaaaggagtcagccaagggtggtgggattatcattagttcttacaggttttgggataggcggtggagttaggagcgatgttttgcgagcagggggtggatctcacaaagtacattctcaagggtggggagaatgacaaagaaccttcttaagggtgggggagattacaaagtacattgatcagttagggtggggcagaaacaaatcacaatggtggaatgtcatcagttaaggctattttcactcttttgtggatcttcagttgcttcaggccatctggatgtataagggcaggtcacaggggatatgatggcttagctcagagtcctgacactgatacagtgccaggatttgaaggcgggtgtggcttacctgatttcatgtacaattcatcccatagggaccttgttccttggcctcaagttgtaggccctttcatatctctgtacggtcaagaaacatggtggttcccttgtcattcttcatcctccaaaaacccattgagcactgtgtttgctggaggcatgtgggaaattattctactgtaccctatatcctgctgaagtgcctgggtactgggtggctagctcatgtccatttgctaagacacatgctcacgattcttgcctgggtctgacataactttggagtcttgttgcattcctgggctggactctggaatgggacccaattacttctgcacctggatacccccaaccttctctgttgtggtggcggttctttcaccatcccctcctctcaggaacacactcttgtttctactttacattctccatccagtccaggaaaatagtatctaggctcagagacggagaaaatagtgtctatatttcacatttttttccaaaaaaaaaaattataattttccgtgcctggacttgagaatttgaaaactccaaaatcctccaggttcaaccacattgttcccaattacaggattttcttattaaagttgaatagtgttccattgtgtgtatattccacatttttgaatccgttcatctgttgatggttacttaggttgattccatatcttgtctaatgtgaatactgccacaataaacacgggtgtgcagatatctacttgatatactgatgtcatttccttaggtatgtacccagtagtgagattgctggattgtatggtagttctatttttatttttttttgaagaacttcctgctgttttccataatggctgtacctatttatgttcccattaagggtccaaggtttccctcttttccatattctcaccaacactagttatcctttgtctttttgagaatagccattctgacaggtgtggggtgatagcatattgttttaatttgcagttacctgactaatgataagcattttgtcatatacctgttgtccatttgtttcccttaagacatgctcgttgagacatggacacggggaggggaacatgacagaccggagcctgtgggggtgggggcgtagggagcaaggggagggagagcattaggacaaatacctaatgcacacaggacttaaaacctagatgacgggttgatagatgcagcaaaccaccatggcacatgtatacctatgtaagaagcctgcacgttctgcacatgtatcccagaacttaaaaaaaataaaaaataaaaattcagttccttaatcacagttgccactgtgattttactttgtcatattttaaaagcttttttatttcaaaaaaaaagtctgttgaggtcctttgcccatatttaattgggttgttgtattgctattgagtttaaggtttcttatatatttttggatattaatcagagtgaagggacaactcatggagcaggagaaaatatttgtataccatatacctgaaaagggattatttccttggctgtgcagaagctgtttaggttgatgcaacttcatttgtctatttttatttttgttgcctatgctcttgggttcatatccaaaaaatccttgcccagaccaatgtcataagcttttagttgatgtttttttttttttttttttttttttttttttgagacagtcttgctttgtcacccaggctggaatgcaatggtgcggtctaggctcacagcaacctccaccttccgggctccagtgattctcctgcctcagcctcctgagtagctgggactacaggcgctcaccacaacgaccggctaatttttgtatttttagtagagacggggtttcgccatgtttgccaggctggtctcaaacccctgacctcatgatctgcccgcctcaacctcccaaagtactgggattacaggcatgagccacctctcatagtccatgttttcttctagtagttttagtttcaggttttacctgtaagtctttaatccattttgagtcgattcttgtatataacagataagggtccaattttctttttatttatttattttttttgagatggattcttgctctgtcatccaggctggagtgcagtgatgggatctcggctcactgcaagctccgcctcccgggttcacaccattctcctgcctcagcctcccaagtagctgggactacaggctcctgtcagcacgcccggctaattttttgtatttttagtagagacggggtttcaccgtgttagccaggatggtctcgatctcctgacctcgtgatctgcccgcctcagcctcccaaagtgctgggattacaggtgtgagccaccatgcccagctgtaagggtccaattattaatattcccaattgaatggaagaagtaaaaggaaacaaaattaaccatattctcacttaaagtcattgttatcattttggcatatttcattgggttcctttttacccgaaatgagggttttctgctatttatttagatgtgatcgtgctatatttatgacttttcacccttttttactatcacataagtgattttaggttattatagacacactttaaatgttcacataatgaccacttattctaaagttaggcatttagttttttatttttgttgttctaaataacccagtagaccattttgtttccttttagacagcttccagcgcatgaaattattaggtcaaaggatattacctttttttttgagacggagtcttgctctgtcgcccaggctggagtgcagtggcgcgatctcggctcactgcaagcttcgcctcctgggttcacgccattctcctgcctcagcctcccgagtagctgggaccacaggcgcctgccaccacgcctggctaactttttgtatttttagtagagacggggtttcaccgtgttcgccaggatggtctcgatctcctgaccttgtaatcttcccacctcggcctcccaaagtgctgggattacaggcttgagccaccgtgcccagccaggatattaacattttttaaagggtctttatatgtatcgcaaaaatacttagcaaaattattattattattattttttaccagtttacactgcccaccaagaagctataaggacacctaaattgtcacataaaactgtgtatggataaatatctctattttataaaccacttggtataaccaaaatcctgcttttgagatattaaattttgaagctaacattcttagcatgtttttaaaataatactgacttcatgagctaatacccataatgataaaatgattttatattccaggaaagctgccatgtgggattgaatgttttatatatgatacacttttatctacatatgttgttatacagtcattggtacctttttattagatgaatttatttcatattcagtttccactgaattgtattcagcttgactacaaattagtcaagcagaataagaatgtgagttttattgtgactaatatatatttggagtctagatttggagagacaaggggtgagtaaaactgtgtgcctactacctgaaaggaaaggttttttttttttttttttttttccccctcaagggaaacaattacggagactgcccaggcatttaatattttattgaaatattctaaaccctcaaatttcgcttctacattttatgtgatgcatcagaaaaacactattttatttgttttataattctccaatagggaaatttcaacacattgtaagtttctttatttaacaacatcatctagcttttaataactgactttcatacacatttttaaaagcaggctaatcgttatagcttaatatatttttcatgagatttagtgataacatgatcacttataccagtagtttatctcctgaatcattttaaaaagtaatgtgcatgttttctttatatttatatacaattgggaagcttaatatttatgaaaatatgattgacttttttttgtcatttctcttcaaagccttaggctttgcagttatcagtagtgcagttccaagatgcaaagtcataaacttacctttcattctctttagtaggcttaatattttgaatctagccataggaagcagcctgaaacctctaatcgaaatcaaagataacaccacaggggtacaatatctctaatttgtcttggaatgatgcggtagcttcccttgactgctgtgattaaattcattctggtttgttcagttaatgagattagcacatcttaacccataggaaatattgtctttatgggcctatgactctgaacagattagcatcatgatcagaaaaataatttttaataaatgattacgtgtgagtggtgctaggctaggatccctacaaatctggcaagagcatattccttgaccttcagcattatatgactttataagacacagcattttctcaggcatgggtataaatacagttaaatatgtactataaaactaaagaacagcctgaaatttaagaactacaagaatttgtgcttgtcattaagctggagataaagttaacatcctgagaagatgtaaaggcgacagtgatacacttctccttgtttggtaggatcatttccacacttgtctgtacttggaattgtaaggtgatgagtcccttaatgatttcttattgcaagtttgaacctagtgtatttcatggtaatagactaaggggaatgagtatatgaaatgagttccagtgtattgatgaaacttagagttgcgtagagtggagcatagcttagtagaaacttgagcaagttactgtagcacatggtcctggttccaattccagcaacatctgttagttttaggacttggtgcaacttgttcaaattttctgtcagactctccattggtttaaaaaataaaattcaaaatattgacaaatattgccttcctgaattttttggtgaatattaagttagatgatgtatataaagtgcctggcccatagtaagggctcaataaaagtagctgttggtaccgcttttaactaattgttgttaaattgattggttaattatatatttccctgccacttaactgtcactcaacagcttttcctcatttcctgcctacctgattggaaatcattatgttgaatatgtctagaattatcactgggcctgctgtattccctgggtggtatgtttgtataggttgaaccactaaagaaaatcttttcggatgagttactttcctatgtcaccctactatttcctagtgggaactttaagttccttcagtctggggtcaagactagtcttagtataggggacattgggaatattgaggatggcatgtttaagtaacattgtatgtattggtcaagaaaaaacaggcaagggatagagtacatcaaaaccagaaaacctatgtacttacctttccatttctgtctttattagatatgttgagtttatttcaagtgcctctatagaacatctacagaacattaatattaagaatatcatgaaaagggatacatttttaagagcctaaattttggataaaatggaagtcattttcttttttttttttttttttttttttttttgaaacagagtcttgctctgtcacccaggctggagtgcagtggcatgatctcggctcactgcaacctctgcctcccgggttcacgccattctcctgcctcagcctcccaagtagctgggactacaggtgcccgccaccatgcccggctaattttttgtatttttagtagagacggggtttcaccgtgttagccagggtggtctcgaactcctgacctcgtgatccacctggctcggcctcccaaagtgcggggattacaggcgtgagccaccgcgcctggccatggaagccattttctaacaacaaatttaatttgtgaaaagctggtagcatgttaactctagaatgacaattttttaaaaggaaaattccaaagttaaagggaaaaaatattggggtagtgccagctagtatcaggatttatactttaaaaatgcataagaaagaagcaattaccagtgtccaaataagaaatgagagtaatagaaaactcagatttcattgtattataaatttaataaataagttacacaattgccgttcagtgcctgaaattgatttttctttttttgaggtcaaacttcaaccatgtatatgaaatgtaagagcaactttctaagcagaattaccctttctgatttccttgggttccttttggttctttaatctgtatgactaagagtgtggattggctgacattatgagatgcaattaatttacatgcttaagttaggactataccatcctgtttccatccattcttgatcacaagcatattacaaatgctgtgctggattatctttactattaagacatactgcagaaagccctgcaggtaaagaaaacaatctagggcttaccttagaggcaggaagaattgcatgttaagaaagctgcatacactctggctttttgctctttgagtttagctcaatgtcttcctaaactttggtgtgcaggaggtgactacgcagtatttaaaatctaatccatattatgtgtatagtatggatggtatagcaattttccaggtggatttttgacaatattttattttttactattcatgttgactttgaaaaataactacagggctagatttgattcaactgtccatggttagaatttttaaaaaagtttttgactctaatacaactgagttccatctacagaaagaatgcacatatggatacggctgtccagaagatcaaatatccttgtactgaagtatatctatatttagtcattattttataaaagtagtagaaaacaatagtggaatataatatgtggtctttggaagaatgagaaatcatccttacccattaaacacagacccaacacttaatgtatttccattttgatagtgacaagttttgggtttgggatgatgtgtcagccagggtcagttaacagacagaaaccacttgagtgactgtagcagaaaataatgtaacaagaggaattgggatctaggtattgaaaaattgacaaagagaagaggtagcaagtgcacaaagtagctaccgctcctagggctgggaagacaaaaggttagaattactaacacttagaacccttgaggaaggactctacaaagctgagctcaggtctgagtagggggctgctacgtggctggtgctaccctctctgggatagcaggaagggcccaatgggactgaggcccggacctctgccagccaggtggtgctggtatttctgcagcaggggcgatgaagctgattctctaagcttttgaaaaacaaaacacaagctaaattgaatagcttgttactaaaaagtgctgctgcaggcatgaagaagcacgtctagggaactgctaataaggacagtaagtgcatgggaagctagtgtgaatgagtaaatcctttgtccctcctccaggcttgcagtctccctctattgctccctacctttagattctgagagtcagtcagtaaagccagaagtacggtttgcagagtctttgcctcagcgttgcaaagtagggtttagaagggtgtgttggtatggctctgaggaagataaaatctctaaccagcatgagtgctaatatgtctaataagatatatggaaaataattattaagtatttgactgaatttcaaggattaaaaagcaatacttaaggcaacaaaaacatcttatatttccattaaagcataatttttcttacagctccttcacattggcaaaattagtttgccctcttgaatttttcaaagatgtgaattatggcaagtaataattgctgcctactattgaatatctggatgttgtagaactgccattgtatcatatttaacttatttttgagagtgttagatttcctctgatagaagatattttttacttttccaagattaatagtagaaatattgaacatcaaatcattttacagataatactgtcctaacattgcgtaagtatacaattattcatagactcagaaatcataattgtcttcacagaaagaaaccagttcagaatactttaagaactatttggaatgttagatttaaaatattctgtagccaaggtaaagcaagttagctaaaattccttttgtttctattgtttttagaactagcttcaaagagaaagaatttgataaatacttagtgtccaataggctctttcatacagttcaaagatgtagactgacactggcatctacagttcctagctgtacttactctggtattttttgccagctgccttcgtggtttctgcttcatacctgtttgtattcataaataactcaatctaagatttttagctttttaaaaagaattgcatacaatcatcatcagattacaggtttgaaagaaatcttagtttttttctttttcttttttttgagatggagttttgctgtcgttgcccaggctggagtgcgatggcgcaatatcggctcaccgcaacctccgccttctgggttcaagcgattctcctgcctcagcctcctgagtagctgggattacaggcatgcgtcaccacacctggctaattttgtatttgtagtagagatgaggtttctccatgttggtcaggctggtctcgaactcccgacctcaggtggtcttcccacctcggccgtctaaagtgctgggattacaggcgtgagccactgcgcctagcccagaaatcttagtctttttaactcagttttgagattctgccatatacctggcactgtagttaagagatggcatataaatgggaaaaataggtatttcaaaagcaatcaaaagcaattacaagactatatagtatgtcctaccacgggggtatgcatgggagcagaaggaagaagagacgaattttgcttggctagggttgtattggggttgaaattgatatcaactatagactagaaacttaaagggattttcatgccaacaagagtacaacaggccattcaagtccatctcttccaaacattgattaaacatcttttataggcagacaatcagttagttgctaagaagactaagctgaaaaaggcttttttttttttggccctgttggagctttcagcctattggctgattaaaaaaaaaaaaaaatgctgaggagtatgaagtcacaaaccaattgagttcaggaaccagtaagtagtttgacatgaccgtaatggaggttttgggatatgggcaattggcaaaaaattgaaaaggatgcgggaaaggtggactggggatacaatgtggatggatgattccttgctcaattgagatgaatgtgttcaaaaaaaccaggaagtttttttttatgttttgcatattagaaagttacatttggtggctatatgcagaatcgtgtatggggagagtacaggtgtggaggtcactcatgaggctaatgtctattcaaatgggagaagaggaaggtctgaaaggcaatcactattggaatacatgcaagtacatctagcattgttctgtctttctgaagatgtggaaatgaagctctctcagaattaaatgacaacatgccatggctgtttgttagagggaatggaagtagagattgaaggtcttgatttccagctgatcatcctttttatggtaccataccactcacccagcctgttgaactggaaaagattatgaacatcaggcattaacctaccaaagtaaagcaaaacaaaaacgctgaacttctccatatttttaaaaatatgtgacacatatatgtttattggaaattaaaatacagtaaaggctctttaactgtcattcaataaatattttttgaatgaacgacgatcacttgtcaataactggtattaaaaaagacaaatattaatggtgatctttattcaataatttcataaaatgggaacaaagtggtaatttgccagtaggatgaggagggcatagcagaggttgtctaaccttttggcaagggcaaagtcaaactggtgaataagcaacacaagctgtgatgagagtcatgtgccatatgtaaatggtgactctttcttcctccaatgctgtttatcaccacaggcttcccagcggcccaagaacagtctgccgcagtcactggcattaataaatgccatctctacctgaatgcccttcttttcaaatttttaccaaaaggaagatagtagactttcagttttccttctggctgtgagaggcatagggagaataacggtaacagatgcaggaataaaaaggcttgatacacatggatattatgtcatgagggattcaggagtttatattaatatacaaatattagttgttttttttttgtttgttttttgttttttgttttttttttgagacgtagtcttggtctgtcgcctaggctagagtgcagtggtgctgtctcaactcaatgcaacctccgcctcccgggttcaagcaactctcctgcctcagcctccccagtagctgggattacaggtacctgccactgtgcccggctaatttttgtgtttttaatagagatggggtttctccatctcggtcaggctggtctcgaactcctgacctcgtgatccacctgcctcagcctcccaaagtgttgggcttacaggcatgagccattgcacctggccccaatattacgatttatcctgccctacctcaccactcttttcatgattagagatggaaaaatttgatattatttaaaaatcagtaagattctatctaatcaaaccattggcagtataattcacaacttttttagagattttctaaagtaatacagatactgtagtattgtagttttgtagtatagctacaagaaaatcatactgtgctctgaaatgctatcttagtaacatattgtgttaatggattataatggtaatcaaaacctccatagagctacaggtttgaactctaacattctgtcgaagttaaagattaatcagtttaacaccatattatttttattatttttgagacgtagtctcactctgtcgcccaggctggggtgcagtggagcaatctcggctcactgcaagctccgcctcccaggttcatgccattctcctgccttagcctcccgagtagctgggactacaggcgcccgccactacacccggctaatttttgtctttttattagagagagatggggtttcaccgtgttagccaggatggtcttgatctcctgacctcgtgatccgccctcctcggcctcccaaagtgctgggattacaggcgtgagccaccgcgcccggcccattcctagtattttcaaatagaaatctgatgcctttattactgtaattagaggaatgcttatgtttcaggttgggttttggtaaagcccatgtggagaggagaatttgcatgaaagtagtttaattaaggaaatgttctcagggatggcaagtaggtgagcaagagaagtagaataggaatggggaagaaatcatgcaaggagcaatcgcaggcaaagtgccagcctcagtctggttctgcaggaaaacctgggcctaaactatgcttcagcttgttgcaacttgatacagaaggagctgggcttttgtattccagtagtcaccagtcattgccttaagactaccctaaggtgacataaacaccaaggcacttccggatctctgtttttgttggcaaagcagctttactagcctgaagacagtcatctaaagagatgtagatacagaagttttgagaagcaaagaccacaaaagccaaggaggtgggcacgcagaagtgttaatggaatcttagtggatctggataaaacacgattttttggctataacctctaaagggctaactttcagaagattacgtggacccaattaagcacttacctgaataattttgaaacatctctaattgtactatagctagagttaaaagaaaaaatattttctaatataaacaaaaagttcagaattatagcattattaaagaagcttttttcaaatgttagcattcctgcttcttgactttacatttttccggaacaaaatagttttccaaagagtatacttaatgacttgtgcagatgaattctaaatgataaccacagggctcttggacaagggatcatttaaattttgagttcttgtcagtcagacatatcaatccatatacatttccccaaccagggtgtcagaagtgtagtcaagtgagttttgtaatgatacttctttgtttacatctagctgcagaaacctcttaagactgattctgcatcagaataattgctagagggaaaagggaagctgtgattatgaaataacactgttatccactggcacccctttgtgtctatcttagttgaagctttgaggcacttctgtgtctattatttgattttaattggcaatggtattgattataaatcatttgacagaatataatttttatcttaaagtttaaatgtacctagaggctacaaagattcctgcgttcaatgaaaacattaaagtaatagtgtaagtagtttaaatgtgccccatttggcacagattagtgtcacctatggtacaactcagtcaaaaagtgaatgtagctgaaaactgaaactgttcaacagctccaaatttaagaaacacggaacattcactatgtgcaatagacaatgctagttttagtaggggattaaaaaaaaatatctttcagccaggggctcataaagtagtgaggaaacctacaacaacttcaagtcagataatgacaatatgtcattaagggacatgaacaaatgaccgagagaccgcaagatcaggagggactttttttggagttggttataaaggaatggcaaggcacatgggaatcaagaattcattcaaacagagccttgaagaaaggtgttggtggagtggaaggctagaacacaaaaatacaatctacagaataagaaagcactagggggcaactgtggttggagtacttacaagaacggtttaggaaaataactagttgtactacatagactaaattggataactgtcaagatttgaggattataggtgaagaaaccattttagagtttattataactgacattttgtatctagagacaacagggatatcagtattgatgtaattaaaggatgtggcaagaatgaggtgaaaataacttatgtcttagggctgaaaaattgagaggatggtggtatcattggatatggttagaaatagaaataagcaaaactatgatggggaagtgatttgtatttgggatatattgtctttgatgtattgatgggatatccaataatctccggaaaatatgtctggatctgaggagggaaatcagtgtgtgtttgataggtgtagcagtgagaaagtatcataggcaagataccacaactaaagaaaatggtttgggggtaatcaatatggagtttaagccatgggggcagatgatacggcaaaaggatattatacacagttaaaaaggaacccaaaaccaagtcttggagaattcacatttaaatacgtgcagatatagagaagccagcaaagaagtgttaggagaagtcacaggaaactgtaaagtgtctggtcacagaagcagcaagaaaaacagtttttaaggaggtgactacattgaccaaaggcagtgattgaattgaaatttacttggggtctgagaaaagaccattcggttttctggttgctttgactaattttaaagtaacaatttcagtggagtagtagaccataacctataaatgcattgatgtatttatttattcattcactcactaattcacttatccaatagtcattcatttattcttcggtgcttacaaccgggcctggcactggattaaagtgaaattagaagtagataaactggtagagatagccaaaacatatctccctacagaagggaaaagagcagaaaattatcatggaaacactttgcatagagtttctcacagcaggttgaaagtatcctaaggttatagcagtgtaggctggaggaaaaggagaaaatacagactaggcaggacaggcactggggaaattcaggtgtaactaagaagagactgagtgctgggagacagggtgtaatctgttaaatagaaacataggcaatagtaaatcagggaaccagaaagagttcaagagtcgatgaagagggacatgtatcaaggtctcgatcgagagggctgtgattcaaggcagagcctccattccagagggagcttaggatactcttctggttttctattactatgtaacaaaacaccccaagtacagtggcttaaaataacatctcttttatctttttatctgattttgtgaatcaggaattcagccgtgttcagcttattgatttttctactctgtgtggtgtcagttgacatcacttggcagaattcagctagtggatgtgctggtctggagggttcaagacagattcacttaatgcttaatgccattgtgagaatggctgaaaggctcagttcagcagggactgtcaaccagaggacttgtagatgtcttctacagcatggtggtttcagggtagtcagtttttatgcatggcatcttagggctcccagagtgagtattctaagaaacccataaagaggctaaaagttactaataatgatctaatcttggaagacctataacatcatattcgttgcattctacttggcagacaagttgctaagacaaatccgagctttaaggggagaattagatgctgcctcttgatgaaagaagtgtcaaataattttgtggccatttctagtccatcataactgctgtaaatttcctcctcctaccatggtattgagtgatgcatatctcacaggaggagagtgtgtcagtgactctagctgagaagggcagaagaaagaagatccttgcacaaacaagccaggcgagagagaaaactggcagtttttaggaaagaaaagagatgcatcttggcaggaaacaattgatggtagccagagttcaaggctcatgctgaccgttcattcttctacattttctaagctcaatctttgtatcaatagagaatatcagaaaacttccttggggaatcttactttggctctctgtaaaaatgaacttgtcgcaatgttctaccctcaacaatgggtgaacacagatttaagaaaaagacatgaaaagcttatctgttcttttgtgaaagtgccaaacactttctgttaaggttttcattgttgttaaagtgaaaatttggtatgacagctgctgtgagggatagacttaaggccttgcaactcaaattatggtctgcaatctaggagcaccagttgaggttttgttagaaatgtacattttcaggcgctatcctagacctcacacgagtctgcacttgactaacatcttcagaggtttcatgtgcaaacaaatgttgagaaactctgatctaagggatgtttcattattcagatcattgcaaaggacttgttaggttcctgttcttggtcttgtccctgtggacttcagattgaaaatcttacccttagcttaggctaagataaaattcctttccttttatttgatggcaattatacataacatgtcattacttgatttttattcgactttggagaagcaaagggttttggctaatttttagtaactattcttagcttttacaatgttatcattttatgtttgcattttttcctagccttatttagattctagacacagaataggggactgtgagtgctgagagtatccttagagaataaccactgtaacctacttcattttcatataagaaatgaatgctcagaaatgtgccttgatgtactcatggctacttaatcagtggtaaagctgagcctagaattatttcctcaaaattgtagtcctctgtacacttggatcagaattaacaggcaatgcatgtcataacgggctcatccaggtggttctaatatatactaaagtctgagaaacaggcctgagtgtagcttcaatgtctgctctctcactctaatgcctactgcctgccatatctagatgcctgtgtgtatgtgaacgaggagggaagagaattaaatcctagagatgttggtagccaattatctcaaaagcacatatttaggggtcagcttttaaaaggaggaggggggcttattcccctgacatttgagcaaagcaggaaagggtcggtgatgaaatgccatgtgtcctgaggacctacaggcctgggttatatgaccacttcaggaattgcatagcaatcaaaaagggaactaaaagaatcggaggctgggtaaaatcaggactaacaattgataaagcaattatgatcaacagtgagtgagagaaggagatttacctgatggtgaggtggtagccaccactaagattagtttaaataagattagccaccactaagagttttaaaatgaatgcatgaggcactggagtcttccattgcttctcttgccctccttgatgtcttctgacaggagccatagagatctttataaaacacaaactagatcatatctctcctacccaaagcctgtaaaagcatctctattacatttagtttaacatctctactgtggcttaccccttatccttctttgcccactaacttcatttagcatccacttcccctacttccctttgtgcatcttgtgcctgctatctgtaattcttccctttttataaaatctcctttttaagatcataccttgaattgtatctcttcagaaagggcttcctatagcttagccttaaaattctttttcagttgactttatttctaccttagcatgtaaaatgttgtcatctcttatttgttgttcatcttcttgagacagtaagctccagaaatgcagaaactaaatcattattcaatctaacctcatgtgatatctgtcacattgtagataatacttgaattttaaaaaggggacagaagtttcaagaacagtatactgtggtttaagtgagcaattcactgtgtgtgatccatggggtaggatggttcgaggtaggtgagaaagcatgaactggccatgaacatggacgcaaattgatcaaagtcattgcagcttagcaggtcaaaaagctgtgaggtcagagcatcagttaaaatgttcaatggtagttggtcatgatggcattagcaacctttaaatttaaagggacttaagtcacatccagaaatcggggatgacaagcctatagtcatcctctcttgaagtcttctgctgatacaagtaatcattcagtctgttggtctctatccccatgtcaccaccaacgatgactgggatccagtcaagcccttggatatcatgtcctctctcgtgtccttttcataccaatttaatcatgcctggagtgcccagaagcatactttcagtctcgcctgctttgacacctgactcattcatgccttaacctactgtgctagtgttatgatggggagggagggggtgactgagtggatttgacctcccaaaccatattctagcaagcaaggtacatcttaactctggaattcttctaaacctatatagggtttctgaaacttagtctcagagtgggagtggaatgatacagtactttgtcagaagctcataacaacgactgtgtcttaccataatccattacaatactgttcttgttccagttgaacagctggaagttgaaaaacatttcctttggaatgagtcaaactgtatcttacacaatcttcccagctcttatttacgagatagataatgtcattggtgctcaatatactaaggatttttcaatgcagggctctaatcttatcaatagattccagggaattactgagaaacacattatttgatccttgatgtctctttccttgtatttttatagtagcacgcttgaggaagtacacatatatagcttccaagaatgagggaaggcatcagttaatatgttaaaatagaaacctcccacttgatcttaagtatggggagggcgggggaaggagacaagccttaagcctgtttaccattgcaggtaaacaaacatgaagatcaaattctaagtaaggagagtttgttatggaatagctgagactgagggcataaagacaaccattcaaattattctagggtttcagaagacactgaagaaagaatagggagatgaactgttggtgaagcagagaggaaaaatagaccaagattaagagaaaaaaaacacgggaaaagattgcaggttggaggagggtgggtctatccaaggctgaggtcgaagcttacggcaaggatgcaggggaagaatgttttgttaatggtaaatagattgcaaaaattctgtagtttgcctgttcattctgatgatgggttttgtggttttttttttttttttttttttttttttttgctgtacagaagccttttagttctatctcagttgttaatttttagttttgttgcaattgactgatgtttttgtcaggaaatcaaaatctttgcctgtgcatatatcctgaatggtattgcttagattttcttacagggtttttatagttagtgggttttgtgtttaagtctttaatccatcttgagttaatttttgtataaggtgtaaggaaggtgtccagtttcagttttctgaatatggctagccagtcttcccagcaccatttattaaatagggaatcctttccccattgcttgtttttgtcaggtttgtcaaacatcagttggttgggtattagatgtgtgatcttatttccaagatgttggttctgttccattggtctatgtgtctgtttttctaccagtaccatgatgttttgggtagtatagtctgaagtcaggtagcattaggcttctagctttgttatttttgcttaggattgtcttggctatatgggctcctttttggttctgtatgaattttaaaacagttttctttttttctaattctgtgaataatgtcaatggtagataaatgggaatagcattgaatctataaattatacagtatggccattttcacagtattgattctatccatgagcatggaatgttcttccatttgtttgtgtcctcttagttccttgagcagtggtttgtagctctccttgaagaggtggtgcacttagcctgttagctgtattcctacttactttattctctttgtagccattgtaaatgggagttcatacatgatttggctctctgtctattgttgtaggaatgcttgtgatttttacacattgatttttgtatcctgagactttgctgaatttgcttgccagcttaaggagattttggggtgagacgatggagttttctagatacacagaagagacagtttgacttcctctcttcctatttatccttgatttctttctcttgcctgattgccctggccagaaattccaatacagtgttgaataggaatggtaagagagggcatccttgtcttgtgctggttttcaagggtttgtcataccaaaacctacagccagtttttgcccatctagtatgatattggctgtaggtttgtcataaatagctcttatttagagacatgttccatcaatacctaatctactgaaggtttttaacatgaaaggatgttgaattttatcaagacttttctgcgtctattcattcctttgcattcttttttctctaatcttgtctgctggtgttatttcagcaagataatcttcaagctctgaaattcattcttctgcttggtctatttggttattgatacttgcggtagcattgtgaagttcttgtgttttttcagctcccttgggtcatttatgttactctctagactgataattcttgttaacagctcctgtaatgttttatcatggctcttaacttctttgcattgggttagaccatgctcctttagctcagtaaagttcgttattactcatcttctgaagcctacttctgtcaattcagccgtctcagcctctgtccacttctgtgcccttgctggagaggagttgcaatcacttgcaggagaagaggcactctggctttttgagttttcagtgtttttgttttttgattctcatcttcatgagtttgtctagtttcaatcttggaggctgctgacctttggatggggttttaattgggattttttttgttgatgctgttgttgttgctttctgtttgcttttttaacaggtccctcttctatagggctgctgcagtttgttgggggttcgctccagaccccattcacctgggtcccttctgcacttggaaatgtcacctaaggaggctgcagaacagcaaagatggctgcctgctccttcctctagtatctctgtccctgagggtcactgaccagatgccagcaggaaccttcctgtataaggtgtctagcgactgctgttgggggtgggtctcacccagtcagggtgcacgggatccaggacccacttaaggaagcactctggctgccccttggtcgagggggtttgctgtcctgggggaatcccacttgtctgggcttcccggattctttagagccagcagggtaaagactaagtccgctgatctgcggagaccatggccacccctccccctaggggctcaggtccaggggaatcggagttctttccctaaacccctggctggagttactggaattcctgcaagcaggccctgcccagtgaggagggatgggtcagagtccggcctaatgaggcaatctggccattatttgccatagctggtgtgctgtactgcagggaattcctcctgggttcaaactgtccagtctccctcaaacctgaaggggaaaaatggtggactggagctgcagtgatggctgctgccctccctacaggagctcagtcctctcagtaagccggtagccaccgtgatggctgctgcccctccccacagcagctcagttctcttaggtggcagttctcttagatgccgcccctccccgggagagctcagtcatttgctgtaacaggcagctgcagtgatgatggccgcccccgcccccggaaactgagcagtcttaaggagtcgtctccatccgagtggcctgcgagaatctgcacagctgtgttttgagacccaaggccctgttggcatgggctcgcaagtgggatctcctgatctgcgggttgcacagatctgtggaaaaagaaagatttcccaggcagggtaggacaatcactcactacctcccttggctgggagtgggagcttcccttgtcgcgtttggctcccaggtgggccatggcaccaccctgcttttccttgcgctctcatgccaactgcctagtcagtcccagtgagagaacctggacacctctgttgctggtgcaggattcactcacggttttggttcttctcagtgggagcctctgactgcagctgttcctagttggtcatcttggcctctctccatatttttccatttttgatgtaactttaagtttttgcttaaattcccatattggatattacagtctaaaatcaagagaaggttaatgtggaccgagccattatttaaatttaaggttcaaagaggtaggtcattcagccaggtgagtgagcaccaatcttttaaaaagttggttaactatttgatagtttccacttttcaagctgataatgatattttaaaccaaggtcatttcaatttccttttggttcaatatttttggaaagttgctacctctttgaaataaaaatattttgtacaggattgtttacaattagcaaatgtttgctgataaagatgaatcactgaattaggtaccttttgtagttatgtaataaagctcttggtaaaaacttctatttaagcagttataactaatttttcctattgaaatgtcaggtacctattaagattttctcatagggcaattttaaattttttctttgagctttgtaagaaaaaaattgtcaactctactttcctttggctcttattcaactttattttaaaatgcatttttctagaaacactaactaaaggtgacagttttagttcacagggaactatttttgatttactatttttgttttggaaatgtctgaataaaccactggaaattatagcttataatgaagaaaacaagataaacacactttttatctaaagtgacagtaaaaatctagcaaatgggagaaaaataaagtcaacttttttttttttttaacttctccaattgaacgtcaaatgaacatattgggcaaggaatacaaccttagttgcatttacaatacagtggctacaacagaagagttaaacactaagtcttacgaaaggtagctttagaaatatttgaaagttggccgggtacggtggttcaggcctataatcccagcactttgggaggccgaggtgggcggatcacgaggtcaggagtttgagactggcctggccaatgtggtgaaaccctgtttctactaaaaaaatacaaaaatcagctgggcgtggtggcatgcgcctgtaatcccagctacttggaaggctgaggcaggagaatcgcttgacactgggagacggaggttgcagtgagctgagaccacaccactgcgctgcaggctgggcgaaagagtgaaactctgtccccccccccccacccccccacccccccccaaaaaaaagtgtgtgtatgtatatattaaggttgacactgtatttaaaaaatttctatgaaactgacaaaactattgcttcgttaattcttttttgcaagattgcattggaggaactgcatggaatataatgactgtgttcttttctaatagcacatgagtcagatctctagaaactgacttttgcccatattcaatttcagcagtaaaataatttctagcttgatatttctcataaaaactcctagggctcttttaaaaatattttataaatatctttataatgtggcttaatttttcagacatcttctgtgtagaaacaaatattcatatgtatgtacacatattagctattgctgtgtaataagccaccttgaaactcagtaggttaaaacaaccaacatactatttcaaatacatatgttagccaggaagttcttcaccttactgctaggattactcgtgtgtctctagttagctgggggttggctaaggggctttgctgatctcagctcagctctgcgaaatgtctggctgtctgctagtctgggaaaacttcatctgggacaactagggcaacttgactcggttccacttgtctcatcctcctgctgtctagctctgatgtgctcttacggtaaatgcagaggcatgaacaagagagcaaaagtgttcaagcccttttgaggtctacatttgggagaggaaatgccagcacttcaattgcactctgttggtcaaaatgagtcaaatgccaacccagatttaagaagcagggaaatagataccaacttttcatgagaagaacagcaatgctacattgcaaagggtatggattcaggaaaggatgaaatactaggcccaattttgtagttaacttaccatttacagcagttgctcctggacagtatggcttccttgccaaatatttttgcatgcaaataattggtaaacagtgccaatattggtttttcctaaacaatactatgttaaagtgtcagtcaaaatatgaattaaaaaatgcaaaacatggtaagagcttctcaaaattagttatgtttgaaagggtgaaaagaaaagacaagcagacatttgcctaagcagctttgggtggttaatcaagtcggtacactcggatggggtgtcttgtacctctctagtctcatgttccatccgtccacttacgttccaagaagtggcttatagttccttgaacagtgcgtctatttcatctgatccttagcatgtgaagtttcctctgcttgactttatcttccctttacacttctacctgttgataacctgttcaaccttgtatattctattcagggattttcactctgttgttctctccagtgaagatatcttttatttgtgccagcaccatacttacgacaaaaaaatcactattaataggattataacaccatgctataattatattcgcttaaatgtatatttccttcctaggctattacaaaagctgtgaaaacagtggcagtatgtttttatcttttatcttcccatttttcttaggacagtatgatgcataatactggttacatttagttgaatgactatccccctcgtctgacacataaggaaaataagccaagtgctatgtaatttatcagtgttcacacaactggcaaaatttaaattatagaactgtaataaataaaggcctatttgcttccagatactatattatttaacttacaactacaccgaatctcacatggaagactttcaagtaaggaactggcacttttcagtggatcttaagaaatggctacactaaatgccctagttaaactttttcttctgtttactactacctcatttaatccttatcaacttcaaggattatatttcttatattttgatttatatagccttaagtttttgttgaatgatatttcttctttagttaatataaaaagccacatttttcaaatacattagagtgaattatacattcgaacaatttgcagtgtgctctaaaatagtatttagtaattgagtctgctgagcacactggagtcctgaggagttaatgaaacccccgatgtcaaatgatataacaataggaatttgggactttgaagaattttcctaatgtatatatgtagaattatcactgttactatctttccattacaaatgggacctacaattaggagcaattttattggcaggctatataactgtatctgaccttttggaaatgatagaagaaagaaaagatatattaaactatctttgtagaaaagatgacgtaaaggctcaagtaaaactcacctaacccttgcccctgaatgtgatgatagtcaagcccagcttaaacagcagttgcaaagtaaagaatggtgtagagatctgtagatacactgcctaagtccaaattagtatctagcacttacttgctgtgtgaccttattcaagttacttatattgtgtctgtttcatcagttgtaaaatgggggtgactgtgaacattaaaacaacccacaaaaagtacacagaagtagcgctgacataaaccagtcgatgtgtgtaactcgcatctttctgatacatgaggtagagtcatataaaaattgtaatatttgacaatatttgacttcagaattggaaattgcataaagttggaccactaaaaggaaataaagcatagcagtgacagacgttctcctttaaatattttatcctctgtgacttttgacagaagatcttctttaaatattgtatcctatgtgacatttatcttttctgtgtttccaatttctttgatttggaacttcctgtagacagacccttacaggcatggaagaagaaagaatgaataaaccaaggatgacttcccagtaggtggaggatgggaataattaggaagaagctgtgtcttgtcacctatattgtccatacacaactgcaccgtagggtaattgagaaattataagaatggtaataaatacgttttacattcattaattaaagtcatctttggatgccctttgtccataatgtttcctctactagatctgaagcctaaatatcacttttcttctctgcaatttccctggaactgagtactcatagatgtttgtctagtgagccattccattatgtcatggtatatgtgtgtatttgtgtgtgtgtgtgtgtgtgtgtgtgtgtgtgtgtgtataaacacaatcttttttttttttttttgagacggagtctcactctgccacccaggctggagtgcagtggtgcaatcttggctcactgcaacctctgcctcccagattctctcccaccttagcctcccaagtagctgggacttcaggcgcgtgccaccatgcccagctaacttttgtatttttagtaaaggtggagtttcgccacgttggccaggctggtctcaaactcctggcttcaagtgatctgcccttctcggcctcccaaagtactggggttacaggcatgagccactgcgcctagcctatagatttcttttttgaagaatcagtgttatttgcatgctttgaaacaaagtgcttcatcttgccaaccttgtaccataccgtttctgtcagaaaagcaaccattgggatagattgtaattagccttcatttccatcactggctatctcaaatgcaaatcatgtatctatgtgaatcaaaagaaaaactggatttaggcctggtgcagtggctcatgcctgtaaatctcagcactttgggaggctgaggcaggtggatcacgaggtcaggaggtcgagaccagcctggctaacaaggtgaaaccccgtctctactaaaaatataaaaaaattagccaagcgtagtggctcgcgcctgtaatcccagctactagggacgcggaggcaggagaatcgcttgaacctgggaggcggaggttgcagtgagccaagatcacgccactacactccagccaaggtgacagagtctcaacaacaacaaaaaactgggtttaactttcagaatgttcaattttataggggatatttaaaggtggtgtaattagtataatcatggattgtaatcattccacaaattttaaaataactttgtgaattacattaatacataaaaatataagataaagcatttaccataattttattaatatttcctttagaatacctggtaaaatgaatgagtactgacctaacttaaagataaaacaattgagacctagctttagaagttagttttattacaaaacatgttaaggatagacctgatcagacaatgaatcatgctgactttttgttaagcatacttctgggttcataacatcccacttacatataacaacttgatttccattaacgatggtgtggtttcctatttaaagttcgaatgcacatctgtttgaatcatttctagtgtacttaatagagtaacatacatattgggttctagttaagatgctttataaaatgccaaataacattttatatctggagagattataaaaacttgtattttgtagctttgctcttgaacacttgctagctgcaaggaataacttggctttttcttgatgatcttcatagccagattttcgtgctttttttggtagagagaagtctctacaagtatttgacgctaaggaataatgaataaatacctactgattttatctgctaaggtccacaaaacattccagtattttgatatcactattaaagaagacgacggtgttccagtgatacatatgattccttacaatgacatcaccagagatagaaatatgaggcatgggaagtaacacgtaggccttcatttattttctgatatggacatccctggcattgatctccttggctcaaaggaaatttgcttccatgtctagggtggtgaatgtctttggcttatttctttggccctactctccacttttgtcttccttgggaggctgatgtctgtggactacatcaacaggctcctttgccctctggctactagttggatttggccaatgagagccttggtaagagagggagagaggaaagaaattccatcacccaatatcaaagctcctgtcagataatcttctcttctcagttctctctctatgtagtaactagaaaccactctccttcttttcattcttaggagtctaagagtagtagtgacacttctctattactagttccagtggtttcattataccttccctcatttttataaacagtcccttattaaactcttctcagattaccaaagtcctgctatggccatataaatttcaaaggagagtgtcattctccacctccaggtgataacatttaacaggagggaatgtaatttatttaatgtttttattgagcattttctatgctaggtaccataccagacatcttacatttattaacccttttaattctcatattttgaagttggtcccttctgttactttgaggccaacattacaaggaaagttatagacgatatggattatttggcttagaaagtttggaataaacgtgtgatagctaacacttacagaatatatcttacaaagtgccatactaagttcacttaaatctttgcaatatcaccacaacataggtaatgatacatgctctttctatagatgaaaagagtaaggcacggagaagttacttgcccaagatcacactgcagagctgggagttgaacccaaggcattctgggtgtacagtcaacattcttattcatggcatcataccattcccccgtgttttccaaagcatattttatcagtgtgacttttttctaaattccctctgcataaatctaatgtatttcagtcactagtattctaactcaaaatacaaaaccagcatttttctatctttaggtgactcctttcaagagaaaactaacctatgatgccacaagtcgtcatagtggccattcttgaggggagcttccacatagggggtgtgaggaagctgctagggtgttgatcatattctgtttcttaaatctcgatgctggtaatataaatatgttcggtttgtgacaattcattgagctgtacacttaagacgtgtactttcctctatgtatattattccgcaacagaatactgctttattatacaataccttttccaactcatatttaagaaaacaaaaaaaaaatcaactcggaaagcttcctatttacatgaaaatgggttgccttatttttctgggagctggtcagcagcgttcttcagtaagttttgaatccccagttttgcaattctttgtggtatttgcgatatttttggtgtttccaatgtctagggatttgtaattgcagaagtatcttgactttcttagcgacagttatgtccatggcttgtcctttttgtaatcagaaggtcatgctaaattatccctgtgttctttactttctactgaaacgtattgatccctttggattttcaggttaaaagaccaatacaactctgaagaatcagaaaccacttaaacaccttcacaaatgcatttcctttctcaaatttttttactttgatttgttccactttgatttggttcactttatttatgccacttgtcaacctacctatctgtgtttctttttgaacactgtttgtgcttccgtatttctttatttcatactaaaaaggatttggaaggaatactgtctcgtttttaggtcctttcgtgttgtggtttgggttaacaaagacaatatatatgcagatacattaaactgagtaatatcagatatccactcagttcacttgataagggaaatcttagtcataaaatgaactgaagacagagagctacagggtcgcctggcccaaggaggaattcatgttttgtgtgcttcacaaaatagttctcatacacttgaaaaggaagccattaaaggttgaattttaaagaaaaaatattgttcttaggatataaaatgccacctgcaacaaagacatggtgtatgttgaagatgaaaggggagaacaacaaaagaatacttaaaaatagtcaaaagaacaagaaaagggaggaaaaagcaagtttctaagtgcatcctctgtaccatctgcattcaccagttttagtaattgtatagggaataatgccttcccctattgacttgcactcccacagggatgccaaactaatagaaaacattttacatgtattctgcactttctaatataatatttttatattatcgaaaagactttaacttgtgtgtgtgtgtgtgtgtgtgtgtgtgtgtgtgtgtgtgtgtgtgtgtgagatcttgcttcgtcacaaaggccggagtgcagtggcacgatctcggctcactgcaacctccaccttcctagttctagcgattctcctgcctcagcctctcgagtagttgggatcacaggtgtgtgccaccacgcccagctaattcttgtatttttagtagagacatggtttgaccatgttggccaggctggtctcgaactcctgaccttaagtgagccacctgcctcagcgtcccaaagtgctaggattacaggtgtgagccactgcacctggccgagttaaacgtttttacacctagaatttggtcaaagaaagagatgcagacaaatagtgttaaaatgaaacataaaaatcaatctatatttattgagtgcatacgatttgccaaatctgtataacgttcctatgtgttgcagttgaacctcacgggagtgctctggagtaataatttgagccccattctaatagtgaataaattgtgcctcagaaaggctgtcacttgcccaagataacacagctagtgagtgagtgagagacctgagttcagaagttagctatttctgcttctgaaacttgggttacttttgctatagtatctataattctatagagtaagttgcaggcaggaaaattagaaccatccaagagaaatagtatgttagattttacctggggtattcatactacagggagaataaaactgagcaccgaaaggtctataaagttacaggctaaatgtagcacatttcactaaaaaaaaaaccacatcagaccgtgggaacgggggtgggggagatttttactcaaaagtacttaaaattacttttacataagtccaggtgtgatggctcatgcctgtaatcccagtactttgggaagctgagggaggcggatcacaaggtcaagagatggagacaagcctgaccaacatagtgaaaccccgtctctactaaaaatacaaaactgagctggacgtgatgacacatgcctgtagtcccagctacttgggaggctgaggcaggagaatcacttgaacctgggaggcggaggttgcagtgagccaagattgcgccactgcactccagcctggcaacagagcgagactctgtctcaaaaaataaatgataaataaatagttttacgttgaaacaagcatatattaaaagaagaaggcaaaatctctaggaatttttagcataaagtatatgctttcaaagaaatttaaaacctgcaggcactgtgtaatttatactgccagactccagggtaaattccttcaatttcatttcctggaaggatgctctggtagaatattctgagaagcactctattagagaatatggtgaatatgactaatagaaattggatttcaattgtgatactttaatatatcattgactctgtgagtttcgaaaataatacgatagcaggaactgtttctctatcacctcactgctttctctctctcggtgccccagctaggtgtacatggaatcccctacctgacctataatcctttactccctctccattttggttacctccagttttaaaagaagacttataaaagaccttggtctatgtatttaagtttggcccacaaagcaagattctgtctgcgtttttgacctttgcctagactttgtctccaaacccaaacgtagtccttgtgtcttggatgctatatgatcctgatggctttgggattcatgttttattctgtactccaagacttctctcacctttcccagtctctgctcctctttttgaataaacagcagtttatcacgcacatacttcttggtctgacagacttcaactttctaccctggattttttcttttcataaaaacaagtatctctgtcagttaacagttaactatattttcttcaacaatggacacattgcagtgcataagattattttttgatgagtttaaaagtcatgctttgctcagataagtgtgaaattttgctcctggccaaaggagggaaaaaaacacatcattttaatggcattgtataccttcattcaatttgaaaaacaaattattacactcaaaataccaaattattccaggttagatatgaagttcttggcagcactattagaaagtgtaaatttattttcttattactagagagctttccttaaagtttcattaaaatggcactgttttaagatttatgtgtatattatgtatagtaaagttgctttgttttagattaaatttatggatacatagtatatttagggggtaaatagatatattgatacaggcatgcgaagcataatcatatcagggtaagtgaagtatctgtcacctcaagaatgtatcctttctttgtgccacaaacattccacttcaaatttttttttttttttgagacgcagtcttgctctgtcacccagggtggagtgcagtgatgctatctgggctcattgcaagctccgcctcccgggttcacgccgttctcctgcctcagcctcccaagtagctgggactgcaggtgcccgccaccaagcccacctaattttttgtatttttagtagagacggggtttcactgtgttagccaggatggtctcgatctcctgacctcatgatccgcctgcctcggcctcccaaagtgttgggattacaggcgtgagccaccgtgcctggcccaaattcttaaatgtacagtaaattgttgactgtaatcaccctcttgtgttgccaaatagatcttactcattctaactagatttttgtacccactaaacattcccactcctcctgtccccaactacccatactacactctggtaaacatcattctactctctgtctccatgagttcaattgctttaatttttagttactgcatatgagtgagcccatgcaaagtttgtttttgtgcctggcttatttcacttaatacaatgtattccagttccatccacgttgttgcaaatgacagcgtctcatttttttttatgactgagtagtactccactacgtatatatgtaccacattttctttatccattcatttgttaatggatacttggattgcttccaaatcttggctattgtgaatagggttgcaataaacatgagggtgcagatatttctttgacaaactgatttcctttcttttgggtatatacccggcagtaggattgctggattatatggtagttctgttttcagtttttttgaagaacctcaaacagttcttcacagtggttctactactttacatccccaacaacgatgtaccaaggttcccttttccacacagccgcatcagcattgatgttgcctgtctgttggatataagccattttaactggggtgagatgatacctcattgtagttttgatttacatttctctgatcaatgatagtgacaaccttttcatattcctctttgacatttgtgtcatctcttgagaaatctctattcaaatttttgcccttctttcaatcagatgattatatatatttttttctatggagttgtttgagccccttatagattttggttattccttgtcaggtgggtagttggccagtattctctcctactctgtgtgttgtgtcttcactttgttgattgtattccttgctgtgtagaagctttttaacttgatgtctcatttgtgcatgtttgctttgattgcttgtgcttggtagggtattgctcaagaaatatttgcctagaccagtgtcttggagattttatcccaatgatttcttgtagtagtttcatagtttgaggccttagatttaagtctttgttccacttagattgatacttttgtatatggcgagagataagggtctaatttcattcttttgcatatccatatccagttttctcagcaccatttattgaaaagatggtcttttcttcagtgtatgttcttggcacctttgttaaaaatgagtttactttaggtctgtggagttgtgtctgggctctattctgttccattggtctatgtgtctgtttttatgccattagcatgcatttttggttagtatagctctgtagtataatttgaagtcaggtaatgggattcctagttttgtaaacaaggatcatttgattcttccttttcaatctggatgccctttgtttctttctttgatctagctaggacttgtagtaatatgttaaacaacagtagtgaaagtgggcatccttgttacagatcttagagaaaagtcttgtagtttttccccattcagtatgaaattagctgtgggtttctcatatgtggcttttactgtgttaaggtatgctgcttctatacccagttttgagagtttttatcatgaaggcatgttgaatttttatcaaatgctttttcagcatctattgaaatgatatggtttttgtccttcattctgttcatacgatctatcacattgattttttgcatatggtgacccatcttggcatccctaggacaaataccacttggttataacgaatgacctttttaatgttgtgttgaatttggtttgctagtattttgttgaggatttttgtatcagtatttgtcagagataatagcctgcagttttgttttctggatatctgtctggttttcgtgtcaggctaatattggcctcacagaatgagttcagaagtacttcctcctcctctttttcacaatagtttgagtattaggtgtttcaatgtttggtaacattcagcagtgaagccatcaggtctcgggcttttcttcactgggagactttttacatctttgatctcattacttgttgttggtctgttcgggttttgcatgtcttcatgacacaatctaattttgagtttggtttgctattctagttctttaagatgtattgtttctcttttttttttttttttgatacaagtgcttattgctgtaaactttgctagtactgatttatctgtagcccacaagttttagtatgctgtgtttacagttttgtttcaagaaattttataacttccttatgaatttcttcattgacccactgatcattcaagagaatatagattaattcccttgtgttttgtataattttcaaaattcctcattactgatttctcagttcattcaactgtggtcagataagatactttatatttcaattttttgaatttaaggcttgttttgtggcctaacatatggcccatccttgagaatcctccatgtggtgatgagaggaatgtacactctgcagctgttggttgaaatgttctgtaaatatttattaggtacatttagtctgtagtacagattaagttcaatgtttcctagttgactttttgcctgatgacgtccaaggctgaaagtggggtattgaggtttccagctctctttaggtctaataatgttgctttatatatctgggtgctccggtgttcggtacgtatatatttacaattggtatatcttattgctgaaatgattcctttattatatgttgatctttgtctcttcttacagtttgtcttgaaatatattttgtttgatgtaagaatagctactcctgttcttttttggttgctatcgacatggaatatctttttacatcccttaattttaagtctggctttgtaggtgaagcgtgtttcttgtaggcaacagattgagtcttggtgtttgttgttgttgttgttgtttgtttttttttttttttttctgtcactgtgttttgattggagagtttatttcatttatgttcagttttattattaagaacttattcctaccattttgttttctggttgttttgtggctttctcttccatcctgtcttcctttttagtgaaggcgatttttctctagtggcatgcttttatttcttgctttttaaattttgtgaatcttagtatatcttcttatttgaggctaccatgaggtttacaaacactataacccattatttcaaacagacaacactggttgcataaacaagaaagcaaagagaaaactaattaaaaactcaaacttcgtctcttttaatctttttgttgtttgtttatatctcattatactgtctatgtcttaaagttattagagttatttgttaactgaaagcttcctttttttactcttcttattcaagatatgagtagttcatacatcacaattacagtattacaatagtttgtgtttgtctgtacttactgagttttgtgccttcagatggtttttctggctagttaaggtcctcttctttccagttgataaattctctttagcatttcttgtagaacaggtctggtgttgatgaaatcccacagcttctgtcttggaaggtctttatctttcttgttggaaggagattttcactggatgcactatcctagcataaagggtcttttccttcagcactttaaatatggcatgacatgtcttagcctgtaagttttctgctgagaagcctgttactagttgttgttaagctttttggaatgtatcttttctcttgctgcttttaggatcctgtctttatccttgacttttgatgcttgccatctaggagccaaggcctgaagttgcatctttatgaatctatctggtgctctcttctattgtggcagagctggcacccaagccacaatacaaagtttgtcccattcttcctttcccatttcataagcagaggaatttttccccatggctaccactgcctcaggctcatggtgagtactgcctggctaccactgatgttcactcaaggcccaagagctttttagttaactaggagtaaacgctgcgaggcctgggtctctccgttctgtgcagtgggttctcctcaggccccaggtgagtccagaaatgccatccaggagccaaggcctgcaatcagagaacccaggagcttgcttgatggtctacctgactgtggttgagctagtacccaagctgcaagacaaagtccactctattgcctctcctttccaaaagcacaaggagtatatccccatggccaccacacttgggaatgcattgggccacacccaaagacagcatggctctgagtcttacccaagacttggtgaatactgcctggctactactgctgcttattcaggacccagggactctttagtcagcaggtgacgaattctaccaggactggattcttctcttcaaggtagcaagttcccttctggccctgggtgtatttaagaatgtcactcaggagccagggcctggaatggggggtctcaggactctgcctgatgccttatcctactgtggttgagcttgtgtccaagttgcaagacaatgtcatctttactgtccctatcctctcctcaagtggaagaagcagtctctctcaaagctgtcagctgcactgttaggggttagaggatggggtggtacaagcactggtgtcttactgggttgtgtgcccaccaagtcccctgacttcgagtccagcacgacaccaagacttgcccaggaattgcagtttttgtagcctagactccctttgaagtttatttaggaccccaaagtgcttgagctcacactggtgagactagctggaactcagcttctaactgctgagatgggtgatacctccctggatagggctggtctaaatgtgccctctatgtgcgcttgatgaattctgccctgtgttgcttcccactgtgacagggcagcactgggttccaatgcaacgtttcacaatcctgcgccctccctcctgcaagcacacagatcgtctacatgagacatggcctctgccaggggatgggggaggggtggtgttggcaattcgtaactgtctttcctaccatcttcagtgcctctttccttgatatgatattaaaatcaagtactgtgattgctcacttgatttttggtttttatgtaggtgcttgcttgtgtggctatctgttcagtttggtgtttctatagcagcggtagcgggaaagatgattgctggaaggttccatgtatttgaccgtcttgttctgcctccctcctagtaaagctattctttaaaaattctagcatgttagggttttgtgttatgttctttttcccatggaatttgaaaatggatctatttgagtagaatttcaaaagaataactcataatttttgtctaagtatatatgtggctggattcacaaagctgggcacacagggactggttggttgccgcaggtatcattgttccctgcttgaagtacccgggcatttacaggtcttgtcattgacatggctacctggttgtaggaatagtctaaatcctatgtttttaatcgtggaagtttaagggatgtcttttgcctggaaaccagggattttcttgacttgtgtgaaattcaaagtttatatgtgatccaaggagtgtatgtaaagagcacagtcacccaaaggctaatgttagacccatcacctgacgttttttggaaagtatttgttgatcccaaggcttgtgagagctcccactgttacatgttctttagtcctttctaatgcttctatgtaatagtaccttttaggaatattttctttgctggactctaagttctatagggtctgggcctatgtctgatgtactagcatatgattcagtacctagctcaggtttattcatgctcaatatgtctttgactgattaaattagggatttccagataggtgatgaaaaagctgggaattacctcatgaggggattgtagggttttaagcagaaaacgatttggtgaagtatgacaaaagaaagacaaatgttagaaagataatcaaatagtaggttataaaaggacaaggaagcaacataagattgaaagaacaagaacccagaattagacagatctgagccataattttggctttaccccattctagtttcatgacaaagagccacatactcatcttacatgagatacttagaggttaagtatgttactgctaatctcagaaatgccacaacggttatgaaatccactcatttaatagtgtgtctcatgagtatttacgttaaaaatgttaaatattatttattgactattatttttccttagtataattcctgagcaaagaactgagtaaaatagatgaaaagctctcacagggttgtttcaaacctaattaaacccgatattcctaaaatttgagttatccagtatgagaataggtcatagcatgcaaaatgtgtatgcacagcaagcatgttttgagtgataaggatgtcgaaccactctgactggtatattccaagaatggttaaactttatgtacccacccaggtagattgtggtcttttgcttctttgtgtatttacttttccctttacccgtaactgccttgatcatgcctgtattttttctctccttcatagaatctatattcatttcagtgaattaattagatcatttagggtataaatctcttactcttgctattcaaactaattcaaatagacttgacctatgataaaatttttaaattttttttgtcatttgaactttccttttttcatccgtcatcttcggcagattaattatgcacactaattatccttaaatatagctttagttttcaaaaggggataatcgtgaaaatgtatcattggaagtgtgctttgttaaattgagtgtattttttttaatttcagtttgggaagcagcatattgagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaacaagattcacacaactggctttaaagatcaaaatgaaatgttatcaagtcttcaaaaactggccgtatgtactttctagctttcaatggtcttataaaaacccagtactgtatattatcactattatttagtctcttctatgctattgaatattaaatgtttatttttgcttggatcatagattattcaaagatgttatattgctacttttctgaattaaagtgggaaaaaactataggtggattttcaactttgtttttcaaagttgtactcttgataaaacatagcataccagaataagacttcaattaaaattaataaagtaatactaagaaatgtctgtgagcctttcataaagttctaagcagcatagttctaaaaaaatagactgacgttgattctcagaataatatgtgagagttacaagcgacggttatcctgacattgatggagtttaaccttagtttattataaaggggtacctgagactgggactgggtaacttatgaaataaagaggtttaactggctcatggttctgcaggctgtacaagaagcatgacaccagcatctgctcctggtaagtgcctcaggaagcttacaatcatggcagaaggagaaggggagccagtgtatatcacattgcaagagtggaaacaaaagagataagaggaaggtcccagactcttttaaacaaccagatttcatgtgaactaactgaatgggaactgactcatcatgaaagggattgtgctaagccattcatgagacatccgccctcatgagccaatcacctcccaccaggccctacctccaatgctgggaatcacatttcaacatgagatttggagaacagagatccaaacaatatcacctagtttttcaagcaaaaaaaaattaaagcctatcaaatgacattgattataaatacctcgagtgttttgagaatgagatttctttggcaataaatggatttcagaaaagacttcattgaagcatttggtttcagcaggaatttccaagatttaaaaaaaaaaaaaaaaactctaaagtttctcttactctgtgaattttatcatttctagtaaaagaggccggtctgatactatgagtttaatttttcacgtgacatattctactttatgatttcttaaaatttttgatagatttgattaaatgttcatttgatatgaacttttataaaacaaaatggttgtaagtagtgttccataatttcacctttattattgcattgtacttcataataatgcaataatttctaaacttaagtaaatttttccactcattttaaatacgtaccattttaccagctatttatttgtttcatacattttttttgctccataaatgctaaccctcattggtcttttaatttaaaatagattcacttatgtattacttgttattacaagctagcttattattgataagaaattattgctcaaagaatatggactttattaagtgatgtgactgccgaaaatagagttcagaaaagtaacctgtatatgtttgaaaacacgagtgcaaaaatatcagctgtatttgtagttttggcctgcagctgatggggagccattgagagtttgcaaaagaatcatatttgcatttttgtaattctttttggtaggaagatgtttgatggtacgaggactaatcagaagacctgaactaagtagcattgggcattaagataagaagagaaacattagaatgttaagatgtgatgaatgaaacttgtgataagaggcagaagtttgaaatggttcctagacatttcatttgggtgactgggttcctaggagggttattagccctaacaggagaatagaagaggaattgctggaatgacaaaaatgataattatttcagatttggatatattccgtgtaaaatgtctttgagacatccaagttaaaaatcctttccattaatcagttggtttacacaactagaatctcagaaaatggttcatgactagttattgattcagaagcaatcaaaatgcttctgagggattgtgtagagtgacacattaagtgaaacgaatagatttcagggaggaatgtctacaatcaaggagtaggcagaggataagatgttgaccaaaagattgagcagataccacaaggggaaagtggtatcacaaaagtgaggagaataaagatttcaaaaaagtaggaagtggtacacactgtcacatgccacagagaggagaggataaattcatgagggattctatcatatctagaggaatggatgcatggattacatctccttaaagcagaatattccttacaaacattgttcttctcaggcaaaatgtgaatcctttcagtaaataagtgagtgaccactgattatcaaaatgcagtcatgccctctgattaggagcgaagatatattgctagttaaatacagaatcatgtgcttcagacggtcaatcataatggtgatggtcagtcatattctgtgtgctgaaaaagtcacaagcctgcccagattcaaggaaaagggaattagatttcatttcctcatggagaaacaccaaggtcaagttatagcaaagcatctgagatgaggatattttacagccatctttggaaagtaccacatgccagaatagtacagttattttacatgatgataaattccaaatcttaatatctagtcaaagttcctgcatatattgttgactagatttaccaatcaagaaagttgttcttaggaagccacaaactgacaaaatccaaatatgttaaagctagatgagattttgcatctcatctagtgtttcttcaatctcattacacatgtaaagttcattaggaccatctactcagtttgtttccaagagaaaatcgagatcaagaaaaaacacaggatctgtatcctacaacattagtatcagacttaaaatgaacactaagacatccagactcaggtccaggcctttcaatctatttcagtagtcctcatatcagttgattccttggaaaaaataactgcaactgagaactgtcatttctaacaataatgtgcctctatgttaacatttttgtgagcagaaatcttggctagcctcagggccataaaaatgctcttttaagaaagtcaataattttccaataggattaaaatttgtgttatgtcaccttgcttgtgaacaaagagaaaatatgttttctataggtcttgtcatttgatagtttaagccaattaacaaaacctgacagctggtctagaatttgaggtaaaattcctttgctgactcaggcagtgaataagaatttaatgttcattaaaatatgtcacaatctgagacccaaaacaggtaccatctgtcaccagttttcactacatgtctaggtatagatacactgtgctaaactctcttctctttacaataagtgtaatttgtttcaaaatagtatcactgataacccatgggattgtgtcctgcttgccattgaggtgggaggtggggattatgacatttaatttgctctagatctttgggattcatatccaaatcatgtagatctattattttttataatcaaaactgatttaagttttaaactgatttggcatcagggataaaaatgaagggaaagaagaaacagtagcttttatgaggtgaattataagacttgtagaatcacgtaaattatcgtgggaagatccaagtcaagaagaaacctgttcctgagtaaatgtatttctgctgtggggactgttggcgtttgctggggaaggacagctctggggaagcagggtgatccaagagattatggtatataagggctacagaagtacttaggaattgaagatattctcaaatggctgtgggatcaaaggacatggatgaagtgctcatggtaactgagcaagttcctgtttgacttgctacctttacctcaactcctgggatggccctcaaataattaattcagacaggatcaatgcttctcaaaatgtgttcccccgaccggcagcatcagtatcaaggaaatttgttaggaatgcacattgttaggccatcttcagacctactgatttagaaactctggaagtggagcctagtcatctgcattctaacaagcctttcaggtaattctgatgttctttcaagatgagaacctctgtaatagatcaacctcccaaagtacaactggtgattagaatgaattggagcacatcttacatgtagataagtaactacacataatataggtggaaaactcaattttgccaatataggagaaattgtcttggcattattctcttatgcgtattcctgatgagagtgaggtgaaggtttcctgggccttttgtaaggatacattatcttttcacttcaaatcatcttgaacagcttatctgtctcttctccatatccactactgacccagtctgatttattgactgtaccttcctccctaccttggaggtaggtctacattcctggcttctataaaaataaagtctgtttattcttttactatcccagctggcctttgccttgtacacattctctagatcttccttttgccacctgaattttctagagctctatgggtctctggcactcatagacctatggttaattattgatatgtagaaatacatattttatgcaataattagtaacaaatcatagttatttaatatgcacatgtaagacctaagcttaaaagaatcagcatcaatggatagacaggacaaggtaattctaatgaattctatgatctaatgtatctggccccatcatggattttctttcttttcctccctcagttaataatcctgggggagttctggaactgggagatgactactgaaagacagaaaaagagagagaaactgagaccaaacaactaatctgccatcatcatttttgatactcatatctaaaatttactaggtataagtctgggttcagtgtttttgtcatacagacatataaaaattcatttattcaataatcacacaatgtaattataacattgattttactttaccttgagtgcacttttttcctaattggatttttttttttttcttgagatggagtcttgctctgttgcccaggctggagtgcagtggtgtgatctcggctcagggcaacctctgcctccctggttccagcgattccttgcctcagcttcctgagtcgctgggaccacaggcatgcaccaacattcccagctaattattgtatttttagtacagacgaggtttcactatgttggccaggctgatctggaactcctgacctcgtgatccgcccgcctcagcctcccaaagtgctgagattataggcgtgagccaccacctctaattttatttttaatggtgactttcactttcatttttgtaatgcttaccaaatgtttcttcatgtggcttaataataaaacaggaggcttattttcatttgtttaggtaccatgaggttactcataggtttttattgcaatcctcttctttaaacataattctcacactcctcttctgacatgtttccaaatcattacatattttgtttaaataatgggtagaccattcagccttacacatatggctatttaaaatagtttctaacattctgagtaagtaagtcaaagaggattgtacttagattttttttttatttttagatttgtgtctttgtgtatattgtgcctctttccatagtaaagaaaaaaaatgacactataactggaggaatatacattgaaattcaaatatggctctcagcttgggacaggtagcatcaacctttgttctagtactaatgcaaatattcacttaaatttaatggaaaactaacaagtgaattaaacaaaatgaatatgcaaaacctatctattgggctgggtatggtggctcatgcctgtaatcccagcactttgggaggccaaggcgggtggatcacttgaggtcaggagattgagaccagccaggccaacatgttgagactcctgtctcttctaaaaatttaaaaattagctgggcttagtggcatgtgcctataataccagctactcgtgaggctgacaggagaattgcttgaacctgggagacagaggctgcagtgagcagagatcatgccactgcactccagcctgggcgacagagttagactccaactcaaaacaaaaaagaaaaaccacctacctattgctaaacccccacaccgtgagttttattttgatttgaattcagtgtataatatcttaatttgtattttggtctattgcattctttcaaacttagaaaaatactgaacttattgttaaggaaaaattagagatgaaacttaaatcttgctttgtttccccttaaaaatggcatgaagactgaactataacatactccaggtgaagcagattctgagtaaaagacaaactaattgaaggagccactagagcattctgcagttcagagctatcaatgcaggtgccatgccaaaatgggctacttagattgtccttttcaggaaggtgtattgactgctctaggtttggggcactttgcttcatgggcaattggtgcatttgtgtcatgacaatttgctctgtggtatgttagttcttaaataaacttacatttgtttcggaaagacaggtatcgcgatttagtttacattcattgtatttgctgccaaatatggggttgttaagtggctgtaagataattttctcctttatttctcttccttcttctcctttgtttacagattaagtcagggagtaatgttcagtacccaggaattgaatttgtctgtgtatcaggcaaagttactgagtcaagtaaaagaaaaactgccctgatttactgatttcacataaaccacttattcctttcaaatcaaccaaagggagtttgtaaccctccacagctcacaggaactttggaaatataaatggtataaaaattgcttcataagacacataagtatttataaactctgaaaagagatgctgaagcatttatgtcatgcccagcgacttagttcttttacttaatgggctctacaattagttttaaaaaataattactcaaataaccagatgttaattgattaatggatgctacaaaaattttatggtcagtaaatcacataatgagattttatctccaaataatgaaccgaatgttaaaactgtggaaacaataatattgtaattttatccaaataatcacagcatttcagaatggcaagtttccttagccattctcattttctcagctcactagcttttcttcagtactcctggtacctgattgtcagttttcgtttgaattccgtcaggaattaaggggaaatccaagatccgtgccttctaatttccacatgttgatctctgttttgccttttgaagcaatattaccttttcacttggattttcttcaaatatttcaaggtagctcttaattacctctagtaggtctttattctacgtttgagtttcttttctcttcttttctcttcaaacttcttgggataattagatagattataactttctacctctatttttctgaacttttgatcctttgcgggcacgattgaaatattttcttatctatgcaaatgagcaaatacacgcaaaagcagattgaactatagtggtgtatggaatgcaacccaggcttattctgtgatctttcttgttttaacaggttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttagtgataccaattatcatgctacagactatctcagagattttttaaacctgcattaagagagtgacattataaccctacaaaagaagcaaccagattagtttttgccctgtgtttagttaaataaaaacatgattcttttgcctgtcttgttgttggagaatggtggtgaggtagagtgctaattaactgaacttgttactgccctagagtgaatttcttccagcccaatagtaacggggaactgagtgacttagagcaggcgaacaaaatgctgggaactgtataatcacagtctaaccccaaatcagagattgctagaaccacgaggaacattagccaactccgttttactcttgagaaaaatgaaacttagggaagaaaagtaaatttttcaagagaagttagtggtaggagaactagggttcaggtcttttgatttcttggaaagttttttattagtgtagttaattatctgactattgtaccttttctgccatagactgctgatttcataaaattatgaatgtggcttagttatactaacacatacgggctgtagattatgaaaacatctcagctacatttggggtatgtggttttattataataatttttaaagatttagtcactaaaatggggtatcgttaaaagttgaacctctttttgtcttatgtagttggatggtagaataatgagtagtcattcaagatataaacattatatataatagtatttaacatattctgccacatagcctggcattataaggaataactttactcaaaattcatagctcaatgcacaggcatacacttccatattcaatagattttaggcaaatatttcctctatattgagacaagtacatggaatttgttttcttgagacctgacatctgataagtagcacttaggaaatgccttttggagacatgaagtttgtagtattgcctccaggaatacaatttaagacagcgtaataaaccagcctatatgattttcaatcacagttcaatgttacttttaatccaattttacgttaaaaaattataatttgaagaaatatgaatataaattgtaataatttcccacacaatcattacataataaaaactccatttgttttccattaaacatactttagcaattaattgacctaatagtagttttagtactatattatgattcctcctgttttatgtgatctgcccatggcttctttgcaatacattggtatttatgtaataaatacatgagacattagtcaatttgatactttttaacccaacactgagagtattcccatatgtacccattgcttccacagattattgctgccataaaatggtcagttgccgtgttaagaaagattgccattatttgataaagaaagttattttgacgtgcatcccttttaagggacatgtttagggagctgtaacagttaactgtaggtcatcttctagttcatttgcattgcatggagtggttctcaaacttgagtctgcatagtagccacctgaggagctaattaaaatgcatattcctaaacattttgctcagaaaatctcatccataagctgtgataaggacctaaaaatctacatctttactaagcctttgatacaatctgcagaccatagaggggatcaacatacactgggatctacttgaggtgggagggtgggaggaagtagatgagcagtaaataagactattggatactgggcttaatacctgggtgatgaaataattggtaagcaaacccctgtgacacacatttacctatgtaacaaaccttcatatgtactcctgagcctaaaataaatgtttaaagaaaatagacagtgatatgtgtgtgaatcccaacattctggttttccacaatgctccctgaaatgtgaaaagggagagcttcttgggaatacactatataaatatgctcattcccttggaatgggactactttttgatgaagtttgtacatgtcatcgaaatattactgatttgattattccaattggtagaaaagcatttgaagccttatttttaattccctagaaattatgagaccaccacctaggcaattgacgtgatgtcttccaacttgtataattctataataaaagaatactggttttgatttgcatggttctttatgaaataaagtccaacatgcattacagcatgtatctcttcacttgctcatagggatacaatgaagataaaatggaggcatagacaagaaagcatttgaggggaaaaaggttgagtttgatatgtaagtcatgtagttcagtgtgtctggagggctttttgtggttctctatctgcttttttttttttttttttttttgagatggagtctcactgtgtcacccaggctggagtgcagtggcacaatctcagctcactgcaagctctgcctcctgggttcacaccgttctcctgcctcagcctcccaagtagcagctgggactacaggtgcctaccatgacaccccactaattttttgtaattttagtagagatggggtttcaccatgttggccagggtggtctcgatctcctgaccttgtgatcctcccacttcggcctcccaaagtgctgagattacagacataagtcaccgcgcccggcccactatctccttttaattttattttcaaacagttacacgctcctattgtgggctagaaataaataaaaggacttaacatcatgtaagttgttttccagaacactaagcttgagtttttcttaagcttatgtttcagttttctctcattgcctttccaaaaattatgctgtcatgggattgatccaaatctttgctggctgtttttgagctcacaggaaggtagaaatggagctactcaggaaaagagaaattaaaaggaggtaaacagagacaacagcgaaatagtatcatataagagcaactgattttcttttatccatgttaaattgaccttgattaaaattacataaggagaattccaagaatatgagctgtaaggttgtgactttgaagaacaaagctcacttgtatgtacattttctataatgattgtgggagaaaaatgagtttcattaatgactactcacatgatatactcaattgtttcaaaaattcttttaaataattagtataaagaatgagcaaagttctcataatggttaaaacctattgtgaggcagggtgtggaaatcgtgattgagatgacaaggcacccagttgtactcatataaagaacactgcttgcgcgtatgattgctgttcaggtcagagctttgaggcatttttgaccttttgaagcagttgcatggcaagagatcaaaacgtgaaaaaataatcagctaggaggactgctctcttgcatttcaaactcagatttgacttgaataatacctggacacaagctgagggtatttaagttgattagaaggtagcctaagaagatagaaaatactttttttctaaatgttggagagataataactcttgctatctggaggcttacaatgagaaaagagggcaaatataccctggattgacttctttaaaaactcaaatgatcatgattccctgtaattttttataaacatacttgtaatttgtgcagttttttctaattgccttggccctgatcgatatatattttatcttgatcataattatgaaatacgatagtgacgaattccatcaacatttgcttgtctggaaaagattttattcttccttcacttatgaagcttactttgtctggatatgaaattctgccttggaaattcttttctttcacggtgttgaatattagcccccaatctctactggcttatagggtttctgctgagagatctgctgttaccctgatgggcttccctttgtaggtaacctggcctttctctctggctgtccttaacattttttctttcatttaaacctggagaattgtatgattacgtatgttggggttggtctgctcagtatcttgcattccctgaatttgaatgttgggctggcttctgctcagtgagtatcttgtatttcctgaatttgaatgtttggctggctttctagattggagaagttctcctggatgatatcctgaagtgtgatttccaacttggttccgttctccccgtctctttcaggttccccaaacagtctttgcttcagaatttacataatcccacatttgtcagacgttttgtacattcatttttattcttttctttttctctaatcttttctgcctgtcttatttcagcaagatagtcttcaagctctgagattctttcctctgcttggtctattcaggtattgacaatgtgatttcattgtggagttgtcgtattgcgtttctcagctctatcaggtcattcatgttcctctgtaaactggttattctggttatccgctcctgttacgttttatcgtggttgttagcttgtttgcattgggttagaacattctcctctagctcagggaagtttgttattatccacctttgaagcctacttctctcaattcatccatattagcctcagcacaccatctcacgccagacagaatggtgatttttaaaaagtcaagatacaacagacgctggcatggtttcagagaaatgggaatgcttttacactgttggtgggaatgtaaattagtttatccattgtggaagacagtgtggtggttcctcaaagaactagaaccagaaatacccagcaaggccgttactggatatatacccaaaggaatataaatcatcctattataaagatacatgcatttgtatgttaattgcagcactattcacaatagcaaagacatagaatcaacccaaatgcccatcaatgatagactggataaagaaaatgtgatacatatacaccatggaatagtatgcagccataaaaaggaatgagagtatgtcctttgcagagacatggatgtagctggaagctgttattctcagcaaactaatgcgggaacagaaaaccaaacactgcatgttctcacttataagtaggagctgaacaatgggaacacatgggcacagggaagagaacaacacacactggggcctgttgctgggagaggaggagagcatcaggaaaaatagctaacggatgctgggctcaatatctacctaatgggtctgtaggtgcaccataccaccgtggcacacatttacctccataacaaacctacacatccaatacgtgtaccctggaacttaaaaaaataaatgtgatagtaagaaatttattataattaatattttaaaatataatgtatgtgatttgaagcattactttcctcatttgactgaaatcacatgtgctgttgaaagggtatattagtcatatgctttacaatttggtatgctaattgtaattatcatattacgccataaattgtaattactgtatttaatatgtaatttatattaagtagtatataccaggtgctttggtgtaagcatatatatatatattttttttttcaagcgagtctaaaggttttgtagttttgtggatttttagtagaataaattgtcttctttctcaggaataaggaaagttgtatgacttattaaggttcaaatatctcattcccattttgtgaatattttgctatattgctaacaacaatttttgcaacattctcaactgtgagcacctctttaagataaaatacatatgctcagaatttgcctcttcttgtacatggcagttcatgtttatgctgtatatgtttgtgcctacattcaaggatgcccaaaaagagaaaatgattattatataattatgtgtaccttctatatcatctatatcctgatgagagatttattatgtgtgctgccgaagcaagcacctgatgggagatttaaaactcctatcaaatagtaatataaaacatagctgtaaatgataagccagtgctttttattatacccaaaatgcaaatagaaatatgccaatgtaccaagatgaaaatttctttacatgttcttcttttctgagttaattctcattctttaaagatcctctattttaacccttcataaaatattttatgttcacgttctggctgtacccattctcagagcatcattttgtagacctctttgtacaagggggatatagttgcaaatggtttgcctctcttcttttttggccagtaagtttaattaaaaatactctaaggctttttatttaaaagaccttttcattgcttcctgaaagctctccacgactagtaagcctgatgccaattaaaaaagaaaataattttttaaaatctggaattaaaataaaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggtggaggttgcagtgagccgagatcatgccactgcactccagccgggatgacagagcgagacttcgtctcaaaaaaaaaaaaaaaaaaaaaaaaaaaaaagaaaatttgaagttacatctcaaataactttggaaattaactgtatcattttgctatctccaactataataggtatttgagaatgggccttgtatatcagtgcaataggttttaccttgtaaatgcattgtctgtaacaatataaaatgtaagcactaaaaaatttaatacattcagtctgagttaactcttggaatctctcattctttatttataaatttaaaggaaaggtaagctaggcagatttctatagtggccatcgagttctaaatgtctttgatatgtttctctttgcttttatgtgaaactctggagtacttagtgaagaagattcctacttttgccactggaaaggcagctaaaaaataatgataataacatcctatccctattcaaaggagacttaattatgaaattattacactgtattcactgagtatgtcattaaaataccatacagacaaaatgctcagcatctgtatgatacgcctattatctcctgacaaaaaaatgaaataacacataaagacaaatacaagtctttttcctaagcctatacttgataatatccatccctaattatagaatgtgtttcattacttcagtgttagatggtatgtagaggaaggccagatggatcagaaaaattaaatctcattgctttgcaatttttgcaggtgcagttaattcacacagttgctcaaattccgtatttaatatgaatccagaagacaacatacatctcttctttctgatacaatttgtactaaagacaatttaaaatgaggaacaaaatacattaaattggacagacagttttacagaataaaccttcttaattatcatataatatttatttcgaagaaacaaatgacttatgatgccttctaagtatttgacaataattttgctcatgatttcaatgtcagtacttattcaagaaattttattaccttacagtaataaattaattattaatataaattaaattattattaaattattgtaataataaattaattacagtaattaatagtaaattttagttaccaggctactgtcctgaactttggcactcattgtatgctacattcagctatgggaagtcctctatacttcataagataaagcattttacatccttgtgattagtaactcagcttcctttgtgaccatctgatcttttgcccaaggattctcccaaagttcaacatataaatattttcttttgcttagagatgcaaatctttaccagatttttgtgccttgtgctaccatgcctgtggagttggtttttaagcatggctatcaattattatctaaagctgttgctatgattatgcagtatgttttaaactgcagaagtgcaattcctccatgcccattaaaacttattgatcactccaaagggttacatatacatagacagacaacgcaatgaaaagccttgatccacagttgtcaacctgattgtgtgtgtgtagtgtattttgactaattttgcacagatttcaatatagcatgtcaagagccaaacatatttaacattgagtaattcttcctatataatagttatgatgtgccattgtttacaatttcagtattctgaatttatatatgtgtgtgtatgcatacaaatacacaccccttaaaaggaaaccaccattcaaaaaagtgtacaagtgtaggagcaagtgagcatagctgataagagttggatgaatgaacattcagacttggatttatatctatgctttgctactaaaaagttttatctgcctcaacaaggtcactttcatctataaaataggaataatattagtacttactcttagggccattgtgaggtcataatagctaccatttattaaagctttacaacatagcaagggagtttttctagatcttttgaataagataatcaattcaaaacacttattgtaatgcctggatcatgcagaaagcttcataactggtacctgttattgcaagtattagtatttgcaaaataaagattttatgctaaattagtaactaatactttatagcttgaatctttctagtaagtatctaaatattcaaatactagaatatctcaaaaggcaagaagttgaaatctcttatcccagcataacaaaaaagttacaaaggcaataatatgtaaataattaaatggaaagttaaaagtttcaattaagaatatcagtcaaaaataaaaggaaaatttattagcctgttcttacactgctataaagacatacctgaaactgagtgatttatgaagaaaagaagtttgactcgttcgtgtttgtggcattatagtattccttggtgtaaatgtaccacattttctttatcttgtctatcattgatgagcattaaggttgattccatgtctttgctattgtgtatagtgttgcaatgatacacatgcatgtatctttataatagaatgatttatatttgggtatatacccagtaatgggattgctggcttaaatggtttttctgcctctaagtctttgagaaatctccgcattgtcttccacaagggttgaactaatttacactcccaccaagagtgtaaaagtgttcccttttctccacaacctcaccagcatctattgttctttgactttttaatagtaaccattctgactggcgtgagatgttatctcattgtggttttgatgtgcatttctctcatgatcaatgatgttgagttttctttcatatcgttttaggtcacatgtatgtcttcttttgagaagtgtttgtttatgtgctttgcccactttttaatgaggttatttgtttttttcttgtaaatttgtttaagttccttgtagactctggaccattgtcagatggatagatggcaaaacttttctcccattctgtaggctgtttatttactctgacggtagtttattttgctgtgcagaagttctttagtttaattagatcccctttgtcagtttttgcttttgttgcagttgcttttgccattttcctcatgaaacctttgcccatgcctatgtcctgaatcttattacctaggttttcttctaaggtttttattgtttggggttttgcatttaagtctttaatccatcttgagttaatttttgtatagattgtaaggaagaagtccactttcaattttctgcataggactatcccagcactatgtattaaataggcagtcctttccccattgcttgttttttcaggtttgtcgaagatcagatggttgtaggtgcgtggtcttatttctgagttctctattctgtttcattggtctatgtgtctgttcttgtaccagtaccctgcttttctggtgactgtaaccttgtagtatagtttgaagtcttagcttttgggctgagacaatgggggttttctggatataggttcatgtcatctgaatacaaaaataatttgacttcctctcttcctatgtgaataccctttatttctttctcttccctgattgccctggtcagaacttccaatactatgttgaaaaggagtggtgagagatggcatccttatcttgggccagttttcagggggaatgcttctagcttttgcccatttggatgtgggtttataatttatggctcttattattttgaggtatgttccttcgatacctagtttattgagaatttttaacatgaagggatgttgaattttattaaataccttttggttgtctattgagatagtcatgtggtttttgtctttagttctgtttatgtgatgaatcacatgtattgatttgcatgtgttaaactaaccttgcatgctagggatgaagcaaacttgattgtggtggataagctttttgatatgctactggatttggtttgctggtattgagaattgttgcatcagtgttcatcaatgatattagcctgaagtttgcttttctttctttctctctttctttctctctctctctctctctttctttctctctccctctctctctctttctttctttctttctttctttctttctttctttctttctttctttctttctttctttcttctttccttctctctctctctctctctctctctctctctctctctctccctccccctccctccctccctccctccctcccaggttttggcatcagggtgatgctgacctcataatataagtttgggagaaatcccttcttttcaatttttttggaatagtttcagtggaaatgataccagctcttctttgtaccgctagtagaattcagctatgattccatctggacctgggcttttgttggttggtgggatatttattattgcctcaatttcagaacgcattattgatctattcagcaattcatttcctttatggttcagtcttagaggggagaaatgtgttcaataatttatccatttcctctaggttttctagtttatgtgcatagaggtgtttatagtattccctgatggttgtttgtatttctgtagaattattggtgatattcctcttcaaatttttcattgtgtttatttgattcttctctcttttcttccttattagtctaactagaagtctaccttttttatttttatttttttccaaaaaccagctcctggattcatttagttttttggagggtttttcatgtctttatctccttcagttcagctctgatcttggttatttcttgtttgtttgctcttggtttgctagtttttttatttgagatgttaggctgttaagatctttctagctatttgatgtgagcatttagtgctataaatttccctcttaacactgctttagctgcgtcccagagattctgataaattgtctctttgttctcattagtttcaaagaactgcagaggtggcagctggtcttcctcccagaagctctgtcccagggagagatcagagctctatccattgaatcctgggtggaatggctgaagccccctcagggaggtcccacccagtgaggaggatggatcagggtcccacttaaagaagcagactggccacgatctggcaagggttgccacacactttcaaacaaacaaatctcatgagaactcttatcaggagagcagcaagggggaggtccacacccatgattcagtcccctcccaccaggcccttcctccaacactgaagacagaattcaacatgaggatttgggtggggacagagagccaaaccatatcataaaataacagcataaacaaaatgaatttaaaattaaagaatagctgaatagttcgtaattgcaactacagtcatatgctgcataacaacatttcagtcaacaatgaaccacatatatgacagtggtctcataatattattatactatattattttttacttttatttttgcttcagaggtacatgtggtggtttgtcatatagataaattgcatgtcacaggggtttgttgtacagattatttcatcacccaggtaataagcatagtacccaataagtagtttttttaatcctcaccctcctcttaccctccagcctcacatagaccaccgtgtctgttgtccccttctttgagtccgtgtgttctcaatgtttatctcccacttagaagtgagaaaatgtgatattttgtgttattgtgttagtttgcttaggataatggcctccagctccatccatgtttgctgcaaagaacacaatctcttttttcatggctgcatagaattccacagtgtatatgtaccacattttccttatccagtctaccactgatgggcatttaggctgattccatgtgtttgctattgtgaataatgcttcaataaaacatacatgtgcatgtgtctttagggttgagggatttatattcttcttggtatacccaataattgttattgctgggtcgaatggtaattctggttttcgttgtttgggaaatcaccaaactgctttccacggtggctgaactaatttacactaatatcagcagtgcaataaacgttcccttttctgtgcaaccttgccagcatctgtgattttttgacttcttaataatagccattctcactggtgtcaaatggtatcttattgtggttttgatctgcacttctctaatgattattgatgttcagcattttttcatatgaatgttttctgtatgtatgtctttttctggaaagggttcatgtcctttgcccactttttaatggtgatgtttggtttttgcttgtaaatttaagttccttgtagattccagatattagacccttgtcagatggaaagtttgcaaaatttttctcccattctgcaggttgtctgtttactctgttgatagtttcttttgttgtgtagaagttctttagtttaattaggtcccagttttcaatttttgtttttgtttcaattgtttttggtgtctttgttatgaagtctttgcagtttcaatgtccagagtggcattacctgggttatcttcttaggtttttatagttgttggttttagatttaagtctttaatccacctcgggttaatttttgtatatggtgtaaggaaggggtccaatgaataggcagtccttttcccattgcttgtttttgttgatttcattgaagaacagatggttgtaggtgtgcagccttatttctcgactctctattcttttccattggtttatgtgtctgttttttgtaccatgctgttttggttactatatccttgtagtatagtttgcagtcaggcaatgggatggttccagcttttttctttttgcttaggattaccttggctattctggctcttttagtggctccaactgaatttttaaatagtctttttcttattcagtgaagaatgttattggtagttttttgggaatagcattgaattaaaaagtgctttaggcattatggccattctgtcaatattgattcttccatgagcatagaatatttttccattttttgtgtgttatctctgagttacttgagcaatattttgtaattctcagtttagcagtgtttcacctccttgcttagctgtattcctaggtatcttatttctttttgacaattatgaatgggactgtgttcttcatttggccttagcttaaatgttgttggtgtgtaggaacactagtgatatttatacattgattttggatgctgaaactttgctgaggttgtgtatcagatcaatgagcttttgggcagagactatggccaaagtatagaacctcatcgtctgcaaacagggataatttgacttcctctcttcctatttggattgcctttatttctctttcctgattgctttggctaggatttctagtactatgttcaatgagatttgtaagagagggcccccttgtcttatgccagttttcaagcacaatgcttctggcttttgcacattcagtataatgttggctgtggactttttaaagatggttctaattactttgaaatatgttccttcagtgcctagtttgtcgaggatttttaacatgaaagggtgttgaattttataggatgccttttctatatctactgaaatgatcatgtggtttttgattttttgttctgtttatgtggtgaatcacatttattgacttgtgtatgttgaatcaacctcgcaaccctgggatagaagctccttgatcatggtggattagctttttgatgtgctgctggattgggtttgctggtattctgttgactatttttgcatctatgttcattagggacattggcctgaagttttcttttttggttgttgtgtgtctgccaggttttggtatcaggacaatgcttccctcatagaatgagttaggaaggagccgctcctcaatttttgggagtggtttcataggaatgataccagcttttccttctatatctgttagtattcaggtgtgaatctgtctggtcctgggctttttctggttggtgggctttttgttcctaatttaatttcggaactcattattggtctgttcaatgattccatttcttcctggttcaaacttggaaagttgtaagtttctagcaatttatccattgcttctaggttttctagcttgtgtgcataggggtgttcattatgaatagtctctaagggttttctctatttctgtggggtcaatggtaacatcccctttgtcattttttattgtgtttatttgagtcttctctctttttttctttattattctaggtagtggtctatctttattattaattatttcaaagaaacagctcctagattcattgaccttttctgtgcttttttgcatctcattttccttcagttcagctccgattttggttatttcctgtcttctagctttggggttagtttgctattgtttctcgttccttgtgatgttcgttttgtaattagagatccttctaactttttgatatgggtgtttcgtgccataagcttgcctcttaacgctgctttgtgtgtgtcccagagattctggtatgttacatctttttaaattttcattagtttcaaataatttcttgatttctgccttaattttattgtttacccagaggtcattcaggagcagtttgtttgatttccattttaatgtatggttttgagcaatttgcttaacattgatttctatttttattgcactgtggtccaagagtgttgttggtataattttgtgggttttaaaaaaattttctaaagattgttttatgcccaactctctatatcatatttttattgtacctttcgatatgtttggatacacaaatacttaccattgtgcctacactattcagtatagtcacatgctgtacaggtttgtagctaggagcaataagctgtaccacataggttggccgtatagtagtctgtaccatctaggtttgtgtaagtacactccacggcgttcgtacaaggacaaaattgtctaaggatgaatttctcagaatgtgtcccagttgttaagttatacatgacttgtagtgattcctaataaactggagacagtggtagaaaaaaagtattttattttattgtatgtccttttgtattctttaaatttgctttgatgtacttatgtttctttttttaaatgtgcattttttaaacaagtggaagagaagatggaaagaaagaacttcatttcttgagcatagtttgtttttcccaggcctatcaaaataacacaatcttactgcaagaagaggcacaccctggaataatatcaggatgctggcaaatgctcttccaatttttctcagaatgagaaaatgtaaattttaaagtttaaatctttttaacatatgtaatcttatgagtaagaaggttgagtatagaaaaattcttcaaatttccctgagcgtttagaaaagatagtggttactgctgatatttaccattatagagcacttattttattcagatattatatcatttaattctcaaaaccaggactggctacataatttgtgggcccagtgcaaactgaaaacaagggcttcctgttcaagacctaagaatttcaagacagtggaagcagagcttgaaaacaagcatggaagcctcctgagcaggggccctgggcaactgcataaattaccagcccatgaagctgtccttgcttgtaacacacctgtgaagaaatgtgttactcttactttaaagatgaagaaaataatgcatagatttgagataagaaccaaccagccccaaatgtcacagtgtataaactatggatctggtgtttaataattgtggagactggctccaatgcctctacttataaccactctaagaggaatcagctcccaaatgtaaagacaagtatttctaaactatttcccatttttactagggaaattaacttgcagttaaaatgaatagtattttaaaaagaaatgtattttcttttcatgatatcattttagagtcttaaatagactcataatcaaaatgaagaaaggtgactgggtaaaagtatagttagctagatacaaagattgttgaatataggtcaaactatattctattctagttttgactctgccatattaaacattttagtgaaggcactacgttattcttatcatgcttgaagttttcctcattctaatgcattgagtgacaggagtatgattccatagatcttaatatataaatagaaatgatagatttaaaacaaacagtttggcaaaactttcaaaatttttctttgcttacaaatgcaacattttgcagataatatcttatagaagaactttggaaactaaaggaatacagaaatatacactgtgcaacagaaattttctctactttctctgtcaaaaatcaaccaatgtttatgtctagcattgtttactcaatagtgtaaagcaaacgttttccaatgacattaaaatatttgaaatataatactccatccacattcatataccataatgtacttaaaccatcatctatgacatgaggttgtttccaaaagttactgttagaaagaccctataaacaaggataaatattatatctagccttcagcatcaaattaaatctaaatgttaaaatgctagctgagagaaatctgttttcataacatttaaagagaaaattacttgattactgtatgtttggtgtatgtaattattttgcatactggtatttttcacgtggcattcatcttcacaattatttgtgtgattatcatcgtccctattttgccgtaaggttcctaaatatggagtttctattttactcatttctgaatgtcctatagtgaatatatattcaataaacattagaattttatagaaaccttgtggttcagctgctgaataacttacacagttttagaattctttgattgactatggtgtccaaagccaagaaacattggttttggatgacgaatcaagttatatctacttctagcaaataactggcattatagagtttgaaaatgatatttatcagggtcatgattattagatttcaaatcttagaatatcaggtagaaatgatattcaatttactctgctttcattcagaactcaaaacaagttttaacaagaggaagtcttaatcaggcaggattcctctggttgttaagaacatctttcccaatggggaaagtttgcttgcatgctaagaaaggagctttctgtttcagggagtagtgagctctgtaataatcaggaggtcatgttaaatggccttcgtagtccctctcctgtctatatttcctaatgattctaacacataattaagtgtcaataatagttatagtcaataactataagccataaggaaatttagtacatgactgattgttttttattctgattgtatgaagtaggttttgagagtgattattaatttgttatatgtaatgagttctaccctatatttacagggtgaatgcacagttttcttatttctccatcccgaaggaaatgaagtagtatttttcaattacagtgtagtagtgattattatatagaacaattacagactcatgtcttactactcttttattaaaaatgattcatttttctttcttaaaaggttgagtatatttttaaatgccgcttcacagtatatcatgttgtcatttccctttaccctccatgggcacatgtatccaattttataagtagataccacgaaaatattaatattacagaaattaatttaagagtcaaatttttagtagcacaaatgttctatgagattggatataactgcatgaattagcttggtattttcagaatctctgcattctggtctgtatgtttaaaattaggtattttcttaatctgcaaaatattatcttctagcctccactgtatgcaaagaaagtgtgctcatggttaaaaaaatattcaaataaaaaaataaattatcttgggatcctactaaaaactgcattttctttgcaaagcaagttttctcatggttaaaaaatattcaaattacaaagtaaatgctcttggaatcctactaaaaactacattttctttttgactagaaataaaactaattttatcacgtaatggtcattttgtgttgggtgcaatgtttgagtttatattttaagctttttttagagctatgttgctttctgctttcatcttgacataacttgtcaacagacttataattaaagttgtttgaggttcagtgattcattctaaataatgaatctatggagatcctagagaagataaaacctgtgcttggcaaatgtagaaactgtaattcttagtatccttttagcctaccaaaatggaaatccttcagtccctcacataggtaaagatatgtctttaacaaaaggtagcctttttaagctatgtatgtcaaagcaatttttacttaagacatcatggaaaagattttattccttcactgttcattgccaatttggaagctgaaataagaagatcctgaggcttttcccatttcctcacatgaaaggaatcagtcctcgtgtatgaggcagggagattactacaaacccttcccttacctcttggcaaattcaggaaaattgctaaaatgaatcttgacccagccagatccctgctcctttgcttgtaaccagaggcagtttcaatgcaggcctcttgtgacttccttggaaacagaccttgcatataagttggattgccagaaggataatgattaccatcccaagaggtaacgttacaatcgtcatgagaggagctctgtgagacggagaatatgataaggaatgattgtctcaccattatatgacttgtctatctcgtaatgcccatgtattgaggtgatggcctctcatgtcttggctcacaaaatgtattattccaaagatggatgaactgttgcccccggcccgctgccaaaagtatgaacaggaggtaattgagattctaaaccaagaagtgtctccagtgatgaatatgggaactcaaatatttgaacataatcactaatttaaatcaaacaagagtagtgtgttttttagcatttgaataacattcaacataaagatatatatggactaatacatactttatgttaaccttttattgtaattttaaaagctgtttcacttatttgattaaagagtcgttcattaccaagttgaaataattttatttaaaaatgtataacataaaataatcaatgtgtatgataaccaaaaatgcattctacaaactattaataagcatttaaaatgttctaggcaatggaattggtactgatgtacgttagtaacattcatattaatgtaaacattttaaacagcatgtagaattaactatcagaatgaattatactctacatttttctcctctgcccccaccccttatttcctacagtttgaccaatatattgaaggggcgctaaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttctagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatcttaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaagtaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctcagtctgcgcatcctaaatcaggagtaattacagaacacatttcctgttctttgatatttataaagtcttatcttgaaggtgttagaatttttaactgatctttttgtgactattcagaattatgcattttagataagttaggtattatgtaaatcagtggatatattaaaatgatggcaataaaattttatgagtgcaaagctggcataaaaattattttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcagcttggctaagcaaatccactagtccaggggtcaccaaactaagacctgctaaccaaatttagcatgctgccagtttggtatggctcatcagccaagaagtgtttttacgttttcaaatggttgaaaataatcaaaagaaaaataatattttatgacatgtcaaaattacataaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaacttccaagcactctactcacgatggtaatagaaaatctaacaaaaattgatggagtgaaaagcataatggcacaaatccgtgaagcttttgatgaatttcttttattattcctagtaagatgtacattaacttgtttgttgtcacattaaacatgtgtttatagacaacgcttagtggacatacagatttatggatactttgcaacattccaacaaccctccaacagttctccaaacagagtaatagggacacctagttgcctaacacttttaatgtcttcaggacttgcctaatacagaaattaacagagcaagctgattcatgtcaatctctgtcttcaaaagcttattattggctcctgtttggagaatggattgtgttggaaaaaaaaaaaaagtgtgttctgacttctttttgttttcaggaaagagtggctagtggtgaaataccttctctccaaaatttgtttgtatcataagttttcggcaatttttgtatgtgcctaaatgagaagtcccattgggcacatacagaaagattcttcaaataaaagctaacataaattgaggatttattatgtgctcagtagtagattcagtgctttattggcatcgcatgtatttttcccagtaacctcccaaaataggtatggctataattactttataaaattatacacagctacagtgtacctcagacaggatttgaactgaggtagctacaaaacctgggctgtatagtaaaatgtctttttcatagatatatgactaaggtaatcctattgatttacctgaagccatcccagttacacctgttgtcccagcataattatatatagcatcaactttcactctcaagtgtgtcctgatttggacggcaaaattatctgaacacgctatatacgacacttgattgataaatttagactgaacgaagatagcaaaaaggcaaacatttaggaacaaattcattaattgataattgtctacagggtggaatcttgttaaagtattgtaatgattaaagaggcatcatgcaaatataaccataagctttatattagctagtgccccgtttttgtatcatctgaagcccactaatatttcactgaatattgaggtcttgaccatctgttgaatagtgttttatttaaatgatgtcctcttccagcttctgtgacacactaccagttgtcacccacgactctttacctgacttgttttattccttctgccttattcctatgggagtatcacacagatccatctctttgcctttctgacttcttttattttgagacagtgtcttgctctgtcacccaggctggagtgcagtggcgggatctcagcttactgcaacctccgcctcctggtttcaagcaattctctgcctcaacctcccgagtagctggaattacaggcaccctccaccacatccggctaattttttttgtattttttagtagagacagggtttcaccatcttggccaggctggtcttgagctcctgacctcgtgatccacccacttcagcctcccaaagtgctgggattacaggcatgagccaccatgcccggccttttgacttctttatctggattatctcctctcattgattcgagcctggctctaagtgactgactcccaaatcatgtagctccagatgtgacactctccctcaaattaaagctttatatctctaaagctatttccgcttgtgcatccagcaactgcctcaatgttcatcaaatgcaaacatttgttccttccaattaaccatacctacttatacattgcacacatattttagttataattcattgcctgtgtgtctagagaagtagcaaatatggaaaaaatcattgcttttggaatcagaattactgaggtttgaatgctgccctttttttttttcccaacttttagtttaggttcaaggggttaacgtgtaggtttgttacatgggtaaattgcgtgttgtggctgtttggtgtacagataattttgtctctcaggtaatcagcataatatctgataggtagttttcccatcctcacctgcctcccaccttccactctcaaataggccccagtgtctattattcccttctttgtgtccatgtgtactcagtgtttatctctcacttataggtaagaacctgtggtatttgtgaaacctgcctgttttaattactagcttatgagcgcaggcaaattacttgttatctgtgcctcagattccagtattctcactttataaaacaactgtcatgaggattaaataagcatttaatacattgcctttaaggtggtaaacattcaataaatgcagtggttcgattcttatttggtggtggagaccatagagatgatgaagatggaggaagattgtggtgggtaggaggagtagaagtgatggtgggagaggtaacgatagtagagatgatgatgatggtggtggaggtagtgatggagatggtagtcatctattatcgacagggaaaaattccataataaacattatctcaaacctaagaaatgtaaaattaccttcctgttttcctcttcaaaacagaatttaccacctgacatctctagttctgtgaatttttcttctactttcttttccttatttattataattagattgtattattgggcaagtgccatcatttccgtcatttcatgttcattcgaattgccaagtccataacctgagccatatacctcactgtggagagaactgccctcctttctaattgatttactaaaatgaatatatctaaaatgatgctttttgatgtctctccagacatgcgaattcccataaatccagatacctccaaaataaaacccaagtgcttcctatggcattcagtattattctcattctccactaattttatgtctaccttcccaataatcattattccacttcagccagtaaattacattacattcgttttgttgtatgccttcatgccactcacataaaatttctcattgcccgtcaaaacaaaggaagcctattattacacttctttatgttttacttagattccattgtagcaaataccgtggatacaataagtaaccaataaatgtttgttgagagagtgaatggtatataattcaaataattgcagtaactaaaatttgacatttcaatatcatttaaaaattctacctagctcttcctggaattgttcttaataataaacgtgaccatcctgatgatctttaataattccaattttacccattagggtatccttatttacccaaaacaattaagggatttaaaattcagctttctaccacatagtttcttaactatctaaggtacatttagtcgattcctaaataattatacagtttctacatatgttgtatttattgcataaatttttctctttacactgagatttgcaaaagtgtctgatgatcttgggtcacaagataattatttctaatagcaaattattcctgcaattcagtgatattattgtacacgtaggtaattatcagagtaaggaactcagcctagggtaaaactagatctattatctagttaattggtatttatccaggagattacttcctaatcatgtagcagttattttaagggatttttaaaaaaagctttaatttatacttttgtagcaaccaggcagaatgaatggcaaattgtttttaagtgaatgccatcttaataaagataatttcccccaagtaaagcgttcataaatgaatatctttgtcctcaaggataatgtagaggcattttgaaatgcctcagttcacctggtctgttttttccctccagggtaagcagacagaatgtaagcttgctttctcggctatttcctgcatcctaactacataggaggataaattgactgatctacatacctgaattattattatatattctacttttcagtttgtttctgttttttgtttgtttgattttctttttatggctgctgtccagatgaagttaaattgtgtcacatctctggaaagaaaatagataacagataagaccgctctgcagttttgtgagactcatgcctaaaacatttttgttttagatattgattataacttcagtttctaaactaaaatctgaaagttgtatggcaaaatataccaagttatttgaaggacctaattagataattaatgtgtccgtgaactttttttttttaatgttctatatgataaattgatcctaaaatatctgggatgttaaactcagtaatgacacttttgcctattggcacagcccatagaaacaaaacattttagatgatttgcttctttttttcctaaggagactagacttatgcatgtttacaggttaattgaggtccagaaaggttaaataacttgctttcagttgcaaaataaggactggtgctgactctcctaaatccattctagtgttatagttgcaatgtcatgttactttttatgtattaaaggaaaatgaccttggtcataaattcaaatttcgctttagacactattttttgttaaaaaaaaaaaaaaaagaaatagaaatcttgcataccatcttcacatcctcaaaaagataaccatctattaaatgttcttgagattatgttgtcttatgcatcaagaataaatcaatagcagtgttttgaagaatatagtaatgtgaattctagagaatgctatgggatcagagaatacttagaacagtaatattcaaactgcagtgcatgaaacagtatcatcacctgggaccttctttgaaatgcagatttggagggcccttcccaaacctgctgaatcagaaacactgctggtgggcccaaaaatattttacaagcactctcggtgatacttatacaccataaaatttgagaaccctcgcactggcatgacaacagtggttctcatgcttcagcatgcgtcggagtcaccagagtttctaattctaataggcgtggagtggtgcccaagaattttaatttctaacaaggtcccacgtgattctgctgctactgatttagggcccacactttggaaatcagttcactggagtgtcttgtcatttacagtctgacccctgattctctttccttatgacagcccccataaaggggctttcacgtatgtccgtgtgaagagaccaccaaacaggctttgtgtgagcaacaaggctgtctatttcacctgggtgcaggcaggctgagtctgaaaagagagtcacggaagggagataggggtggggccgttttataggatttgggtgggtagtggaaaattacagtcaaaggggatttttctcttgtgggcaggggcgggggtcacaaggtgctcagtgggggaggttttgagccaggagaaggaatttcacaaggttaatcgctcggttaaggtggggcaaaaacaaatcacaatggtggaatgtcatcagttaaggcagcaaccgggcattttcacttcttttgtgattcttcagttgcttcaggccatctggacgtaaaggtgcaggtcataggggaaaggatggcttagcttgggctcagaggcctgacaggggccatctattcctgggcaggttaagggatgctactgttgcatcttgtgacaccttactgctttatgatgaaatgatctatccatatgcttgtttcatccactagaattaaagcttccctgggccaggatccatttcttgttcgttacctgtgtgatgtcttctgtgtagtagatgctcaattcaagctgtgaatagaaatgcactatattgagaactggtcctatgagatactatatctttggatgtctggctacagtagctatgtgaaaatgtattcttccagaatgcaaggcgtaaaagaatatcaacacgaaagaagacaggatcacattcccagagctgttacatataattttgttcgttttttgagtgaagaaaatggtactcatacttattcatctaaaaggagaagcatagttgagtgcaaataaaagtcagtttttaatcagaagacctgaactatctgtattcccttacggactcctgattctttcctttaccctctcatactctacatcgagcactgaaactgctctcagcaaggtcgccagagagctccttaattgccagctccaaaggtcactcttcagttcttttccctttttgacctttgtcttgtgcttgacagaaatgattagtcccttcttgaaatttttctctcctgcagtttctgggacattgttctctcctgttttctttcagagtatatcttccctgtcttctattcctgccctttaatgtcagtctacataagactcaaattgtgattttattttcttcttatgatgctttattttttggggaaatatcatttataatctttatcatcacctatatttttgattcacaaattgatatttctacctctccctctctcctgatgttcatccctgtataattcaaatgcttataggctatgtattcctggatttctgactggaatctaaaatatagttttggagtttagatcgtataactctagagagggtcattcacatcatagtctctaagaatggtacatcctgaacttgtgcagtgagcaacctgtgcagccattcacagtggtcttgatatctgccacatcactaaatccctccaaatgtacctgttaaattctctttagtttgttatttttttctacatccttgctgccttcactctagttaaaactgaaatttttctgtatgaaatttttaactgatttctctgcctctgatctcacctctcttatccatgctttttacagcctcccgagggatatcttaaaatgcagttttaattagattattcccctgcccataaatcttgaaatgcatggcgtagaaattcttttgtgatctttagctgcctacctctccagcttcactcccttctcctctgctccttttttaaaaaaaataccagtgctactccaaataatctgcaaactttttagtaccagtccacaattgagataagaagcttgagccagaatataaatcaatgtactccttcctttgtcaagaaagttcggcaattaaaagcaaaataagatcaaatcgtttgttcagtgactcagttgatttatactctggtgaaaactcttttcttcttacagactaatagcaaacagttcactgtctgctaaagtctgaactttgttccgcactgccctatgctttagcttaaattaaccactctttgatctccaaatgctctgtgctttcttaagcttctgtttctttgtacctactgttttctctgcctaagattctctttagatacctttctttttcccattcccatgttacctgccaccgtgctactaaccaccttgtctttctggttatctaaccttgcagaggcagttctcagccatttgtgtgttttttttttttttttttttttttggagacggagtctcactctgttgccagtctggagtgcagtggcgcgatctcagcttactgcatcctctgccccgtgggttcaagcgattgtcctgcctcagcctcccaagtagctggcactacaggcaagggccaccatgcccagctaatttttgtatttttagtagagatggggtttcaccgtgttggctaggatgggcttgatctgttgacctcatgatccgactgctaaggcctcccaaagtactgggattagaggcatgagccacagtgccaggccacttctcagcctttttaacacttctattaaaacacttgccaaattgtatggtaatgactttatttttgcatgcctgtatctccagtaaacgccttgagggaagaaatcatttcttgtcatctgtacacctataatgcataaagcagaagtcagctcatagtaggtattgaataaatatttattggatgttgatgagggattttccaggttttgtgcgagtcttgtcagaaaaacaaaatcactgtgatttaaagagaggaaacgtaatataaggaattggctaagcaggtagtagaaaactgagacgcagcgcaggggatggagaggcaactcaaagcactagtaacgtaaggaagctgctaatatccctagagctggagaaacaatacagaaaaagtgatattaccagagctcagaagctggggctttctaacagagattaaactaaagttaggactgccaggcagaaaattggattgttgaagagggagctagctatccagagaaaacagaagccacagcagagatacatctgctctagaaatgccacccaaggtagttggagaagaaaaaagaccttggcttttctcttcctcccaccttccaatattctgccattgcctccaaatgaacaattaggagggcaagtggtgttgggaaatgtatatccctctaatacagaaagtacagaagaaatgtggggaatagatctgagagcagatgggcatattactgcacagatgggttctggccgtgcatcttctgctcataaactatgtgacttaagccacttaatctccccaagaatctatttcgtcacccctgaaatggaatgtatatggccttccctgtttgccctcacactgtggaaattatattacatgtgtttgtcttgaagaacgtttacatttaaaaaacaatgtctcctttccccaggagaaagttgagtttccaattattaattcagggatggtatcttcccatgaccacatttatatattattcttattctgacatcttctgagagtattcttagtaaagtcttccctggtcagaaacctgtctctttacaaatgaacacatattatgctaccacagagatataaaaatgatgccaggctgggatggcctgaattgtgtcctccctaaattcttatattgaagctctaatctccaatgtgatggaatttggaaatggagactttggaagataatttgatttagatgaggtcatgaagatagggctcttctgaggagattagggcccttataagaagacacaacaaagagcttgctggctctttctccctgccttgggaggacacagcaagaaggaggttgtcttaggctgttcttgcactgttataaagaaatacctgcaactgagtgacttacatgaaaattgatttaactggctcacggttctgcaagctgtagaggaagcatggtggcgtctgcttctggggaggtctcaggaagctttcaatcatgatggaaggcaaaggggaaacagtcacatcacatggaagaatgggacaaggagagtgagacagtgcagggggaggtggcacacatttgtaagtgagttctctcaggagaactcactatcgcaaagacagcactaagccgtgagggatccgctcccatgatccaaacacctgccaccaggccccatttccagcactggagtttacaattcagcataagatttgggaagggacgaatatccaaactataccagaggctgtctacaagccaggaagaaggctgtcaccaggaactgatcctgctggtaccttaattttggaattgtagcctatagaactgcgagaaataagtggctgttggttaagccacccagtctatggtattttgttatgtaagtgctagctgactaaaaaccggctttgttaagcaatgagtattacttctgttttgactaaagttcatagtgatgcttactaacacagtagatggattgaaacaggtcatgatgctggcagtggggcattaagtacacgtcagattgaaatggctttccacattgcactagatccttttggaacccgggttggaagttatttaaacttgaaagacccacaagcatgttgacttctcttaaactcaaggacctttcacactgagagagtttaaagtttaaattgcctcccacagggtccaagtcatcatccaatgcatggtgggtttctttgaacacttctgtagtcattatgagtccacatcatttcaagaaagaagagacagcaacattagttttcatgctaattttcctattcactcaactaatatctaatggattgctatggtatgtaaaacactccagttactttaactgtaaatctaagctttccctcaggaagcttgcacccagcataaactgtcatgaagaagtactaataaaatgttagaaaagttttaaggaagaaaagttcacttcctgcttgagaggcatggaagacttatgggaaaattagcatctgactggataattaaagagtagggaagcattgggctcaagatgaggaaagtgacaattcattgcaggggaaagcctgtatgcgaacaaaacttacatgggattaagtattcttgtttgcctccagcagaagtatgaagtaaaggaagtttagaagtaaggaatgaggttgaaaaggtaggttgagttcataataactaaaggtattcaataaaagattaaggcatgtagacttaaaccttctggtcatggggagccattgcatatttttgagagagagaaatatgatatggctactgtgaaccatatcattttgatctcacttgagagttgggagagagaggccatcttaccttggtttcatagactgggaagggggaaagaaaagttttctctaaagggccagagagtaaatattttaggttttgtgtatcataaaatttattttaaaactactcaactctgctgctatagctagaaagcagccataaacaatgtataaatgaatgagcatgactgagttccagtaaaattttatttaccaaattagatggcagaccatatttgtcccatagaacatactttggggattccggcactaatgggtaaaatgagactattttgctgttgatttttgtttatatgtttcattgtctttgttatagctgtgtttgcagtttttattcttgttattccaattgtggcttttactttatcagtcattaagaagacactaaaacaaatatgactactctcacacgtgagaaagtgagaaatggcatagggcttaaagccagttaaaaaaggatcatggaagatattaataacaatagctaatatgtatatggcttctaccaagtatttgctacatattaatgtatttcacacttaaaatagcattacgaagtaagttttattattgtcactctttgccaatgataacaatgtgtcatagaaatttcaagtgacttgctcatggtcacatagtttacaggaagcatcgcagctaggatttgaacccagacagcctagcttagggtgttgccttcggaaattcctcgccttgctatgttgtaataagttaaaggtgatttcatcaaattatttagctgaaataaaatgcttgactgggactccttaagaatttgccaaagtctatggaagctgcacttattctagattatgtctgttctacattctgaagtatcattgactctagtgtcccatggcaacacttgattatctttaaatacagagacctttttcactgaaaagatttctttaaaatttagatgtctttttcagcatcaaaaataagtggaatttccatataattgaacttttttttccaagtgcaagacttttggagctcaccatggtcttaaccacattatataataagtagtaacttttttcatctatgcttaatattttctctgatgtgagaaattgtatcatcagattagaaagttgaggattttaggaaattaagggaaattccaaggtaataataaattgggaaataaattattttatattgccattagggtacaaagtatacaactaaggatcatattttaatgaaaaatttcagaattaatatcctgatattagagacttcaatcaaattctcatataatccaagatagcgtagtcaaaaccactaaattactgtactgtgtagcaatgaacagtaattctatattgacttatccttattttttttttaagatgggtttctcgtttatttggaacaaaagaaaaatgtagtgttgtagaaatctttggattcagacagacctgttcttgagtcttgactcagtgcttcactgtgtattgaaactaaatgaagatcttcaacttttctattcatgatcaatctgcaaaaataaaagctattacagataacatacaaggtttcttgagcgattaagttttctttttgaaagcctgtgacctgattaagatgcttaaaatgatatatatgtctcttttctgttctttaaatttgaatgaaagtttggcattttaaaaaactttaggtgatttaggagtataattttaagcagatttttagagtacgagtgtccacatatttaactaaacattcaaaaattagttaaaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcagataagaaaacgaaagaagccaaattgaagacaagctctgaaagggaatgtgcgccctctagtgacccacatttatttatcataaggacataggcagcttttgggtttcatcattttaaataaactttacatttgattttaaaatatatgactcaggattttcaacttgagtatattatattgtatgatcatagatttattactctgacaggatttcatctatcatttaagagaatatttctattaacctgtgttaaggtgattttcttgcacagaagtgtgtttcaaagggactttcaatttattgaaaatgaaaaataggctttaggcatctgtggcttagcagcattttatttcccatcctctgggtcatgcagtttttgcccacgtgttttcacactccttggctttataactaattcctctaatgtagcagtatctgacattttagaatttgtgggggtttcttaccttttaatttttaaggttgtttctctcaaagatatttaaacaaaacttataaatgtgacatctgttcaatcatgtcacactttagaaataaatattaccaatgaattttgaaatgattaagatttaataccaaattaaggtaggaagattattttaacatcatttctacctaccagacgtcaaaatattttaggtaagttttactttgtgcagagaagcaatattttacagcagttttattctcttcactgcaatcaacgattctatgggtgccaagatgaatatcaataccaaataactcagacatttttggcattaatagcttaaaacattaaatcattcaatttgtatgcaagggcatgtattttaaaaagcagaatttttaaacatactaagtatataattcggtatgccataattgataataaagaagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttattataactgggaattataacatctttagattttatttaatttgattgctagatgaatagactaatgtaattggaatatgaaagccacaatataagcaaagctgatctcagtttttgtatcttgggtcaaaacctctttaattagagaggtaagtaaacatatttacaagtaatttttaaaaagcatttgtattgtagacccagaaaatctgagacaggtctcagttaatttagaaagttgattttgcctaatcctaggtactcgggaggctgaggcacgagaattgcttgtccccaggaggcgggggttgcagtgagattgtgccactgcactccagcctgggtgatagaatgagactttgtctcaaaaaaaaaaaaaaaaaaaaaaaaaaaaaaaaaaaaagttgatttttgccaaggtggaattcgcgcgcctgtgacacagcctcaggaagtcctgacgacatgtgcccaaggtggttggggtgcagcttggttttacacattttagggaggcatgagacatcaatcaagtacatttaagaaatacattggtttgacctggcgcggtggctcacacctgtaatcccagcactttgggaggctgagtcgggcggatcacaaggtcaggagatcgagaccatcctggctgaaacagtgaaaccccgtctctatgaaaaatagggaaaaaaaattagccagacgtggcggcaggcgcctgtagtcccagctactcgggaggctgaggcaggagaatggtgtgaacctgggaggcggaggttgcagtgagccaagattgtgtcactgcactccagcttgggcaacagagcgagactccgtctgaaaaaaataaaattaaaaaaaaaaaaaaaaaaaagaaatacattggtttggtccagaaaggcaggacaactgggtgggggtgggggcttccaggctgtaggtaaatttaaacattttctggttgacaattggttgagtttgtctaaagacctgggatcaatagaaaggaatgtttgggttgagataagacattgtggataccaaagttttatcatgtagatgaagcttttagctagcaggcttcagagagaagaggctgtagagtgcttcttatcagacttaaagtctgtgttgatgtaagtgtcagagaggtataatgaggcatgtctgacccccacttcccttcttggcctgaaccagtctttcaggttaaattttaagagccctggctgaggaggaagtccctttggagggggagttagccttttatttttggtttacagtatgtttttacttcaggaccagtttgataacagcttttaaatttttacaatttaaagcaagaagtcgctgaagatcgaagaaattaatttacccaagaaaataccagaaagataaaaattagggattaaaacctgtggtgcctgatttacacacacatatatagctatgttatttttttttcttttttgagactgagtctcgttctgttgcccaggctggaatgtagtggcacaatcttggctcactgcaacttctgcctccctggttcaagcaattctcctgcctcagcctcccgagtagctgggattacaggtgcccaccaccacagctggctaatttttgtatttttagtagagacggggtttcgtcatggtggccaggttggtcctgaactcctgacctcaagtgaactgcccgcctcggcctctcaaagtgctggaattacaggcatgagccgccacgcctggccctcagctcagtatatttttaaatgcacatttactttacatttaaagcaacttaaacatacacacaaacacacacgtatcacacatattacaaaatacaagacaatcatgtggccctatcttccccccttccacagagggagacacacttacactatacaaacgtgtatgtgttgtgtgtgtgtatacaaactatcttgatttggagagggaactatttatctaaatattagcttgttttcttttggttaaataggatttcccctttaataatattctgtaattccaaaaatataataattgccatgtagtcaatgcatctcaaagtcctaaaaatatttttagaactaataggatttatactgaatttcatttgatatttttataagatctatttgatgcaaattgaatttgtattctattactcgatttttttttaaagcaaatgccatgtggaaacaagcagagagggacaagttttcccagaaggaaagttgaaaggggaagagtagagagaggttgatcaagaaaaccttcacagatgatgtgcatcttgaactgagccttggaagatgaatagtaggtcatcttcaaatggttggggatttagggtcaggaaagtgcctgtatagtaatatggaattaaaatgtcttctcacttcggaaaactctgaagaagaaaggtgatttttaaaaatacagcaaagttggaaaatcttacctccaaaattatttcttctttaataccaacaaagaataattatagttttgttcctattaatgttaaaacttgcttcctagctaattaaaatgttcattaagaattggtttcataaattatctggtctaggcctagagccctgggaccctgcaatggttaacgtatttcacaggcatcagcattttcctttcaggtttctaaggatgaggcttataagtttttatgaaattctacatgctaagatgtttaaatatgtaaaatggccattcataaacctagttcactaatcaaattagttaagtctgggagcttggaggacttccactctcaaagtttacacatttgggaatgatgagttgcaacttgtatattgaaagtgactgaattaaaatttatgtaaatgtgtcatcttagtttaataggttatgtggcagtcactgtaaagaaaattaacagaacacagtgcccatcaggaggctcttctgacataattagcacagttatatagcactaattcatgtaatgttttactattgacaattcaaaattgacaacttcttaaatggcaaacatttctctagttctttgagatgtttgtatgtgtttttgcctttgaatttattttaaacatttatatacacaggtatctctcagtatttaccatatgggatgtaattaacctaatttacatcatttttatgggaaattcaactggatgaggctgagtctgtttgtacaatataatactgagaaaaattgtcactctctgaatatttggtatatatgccccaggcttttgatattttgaaacttccaaaaaatggaaggtctttttgaaaaattgtcttggtgtagtaatacacttttgccaagaaaaaaaaaaatcaaagacttacttgccctgtatgatgggactttacaagttttaatttcaggggtttctgatgagtatatttgtaaaggagaaaaaaattgtcgcttcactgctaaccataaataataacaaattgaggttttaagatatacttgaagaatagaggacagaatattcatcaataattatagaaataatcattttgtgaacagagaatgagaagttatttttttattagctaaaggagattttaagctaggtaaagttagactgcatttaagggatagagtctgataacattcggaagtacgttaagtacagagttaagtatatgaggaaagtaagttaagcactaaggaatatattagtggactgattccaaaggtgtagggacacattatgagcaacttatgatacataagttcattagcaatggttttatgtgagttgttaaagtggggaaaaaagaattattagaaacgagtaattttatgaagaagcaaaaatacatgtacagaatccaacgttgaatatggcattgaaaataagtcttcagtgttttccttgagggttttaaagaaggtaactgagttgcatctgaatgatatatttcgttcgtaattaaatacccaggctcacttagtgcaaagtatgatagaaaatgccatctgcaaagcactgggaagagtagatagcacccaatttaaagcatgaagacatttaaatcagaggtgtctgttcatttgccatgcatctcagcaaagatatctgaggaatatctagtagcagtgaaatacatgaaaactacacgacaaaccacaaaaagtgatgaagcgatagttgctaaattgataaggaataaaataaacgtgcaattgcttcttggaagccagggtctgagtaggatccgggaaggagactgagttcattgtgcattgaaaatgtcactgaacctaaaactaagcgttggatgtaggccattggcactcagggagagtacatgggaggccttgaaaccctgcctctgcttcctcttcacccttccatcctcattgctggcataaagagatgaggctatccactggcagaatattggagagaaaacaatgctagtagctgacagttaactcccagaactctaagagatggtggtacatgttaagtattagagtgtaggctgactgcacattatgtgtggacaaaaagagttttagcaaggaaatcagagatgtttgaaggaagaagtccaaatggaagcaacataaaataaatattaagattaggttaggaatagctcagagcttgaattgtgtaagaattgggttcagtgtccacctgtttcccatgaaatcaagatatcacaataatgatagaaatgaaagggaagaactccaacaggtgagaagagtccaaactcattaatatgtttctttgttccattttagaaaagaagtataacattaacctctgtgcttatgaataggttattttccttagacaaaacgctctcctcaccactgccctagtaaaatttgaaattgcctttttaaaaatctgtacatcaaaaaacgagcgtaatcactctccatacgatctttgtataaaagggaagttcacgcactgtatgtgacccctttccaaatttataaagtcagacaaaaaattgaatgaggaaagacctttctgtagaatttcacatcctgttgtttgaattgatttgaattatcagaactacgtgccaactggtgtccaggcctcccttaaaatcttcacagacagagaagcaaacagacagttaccatggtgttgactccacaaagccttctttgtgtggagataaccaatatacttggcagagcctctaggctagaagctgatttaatcctaatttacagagaaggtgttttttgattatcctcttaaaaagaccagtgtgagctgagccccagttctgtgtctaaaccatttttatcttgtcaaacaaatgcttcactaaaccaaattacttgataatgtggactaatgcattctcgtctctgttctttatggagttaatagcatgtctggcacatagtaagcacttagtatatgctttatgaaggggaaaaaaaggagacatttgaccgttttaaaaggaaacatacaattttgcctttttcaggaaaatacacctctaaaagtgttacaagatttcttctggggccgggcgcggtggctcacgcctgtaatcccagcactttgggaggccgaggcgggcggatctagaggtcaggagatcgagaccatcctggctaacacggtgaaaccacatctctactaaaaatacaaaaaaaattagccgggcgtggtggcgggcgcctgtggtcccagctactcgggaggctgaggcaggagaatggcgtgaacctgggaggcggagcttgcagtgagccgagatcgcgccactgcactccaggctgggtgacagagcaagactccgtctcaaaaaaaaaaaaaaaaaagatttcttttggaatgaaaattatttactttcaaactaaaaacaaacaactttgtttcttttttctgcagtgaattggaggtggtggtataacagttacatcaacatgcatgttataggagcagaaaggctgtgatccctttccttcctccttatacaggtcatagcagacattcctataacaaaagataggttaacaagagaaaagcatgagatatttatctaataaaagttttaggtgacatgggagccttcaaaaatgaagacccaatgacccaaaggaaaactgtttttatgcttagagttgataaagagtagacagccatgtaggaatgtgattggacaaaaagggaatgatctgatagtaatagactagggacaaccagccaggcctgtctgtgtagaattccttcctcctacacatggggtaggaccccacttgaatgagggtcttatgatctactatcaaacaaaagtatgtcagagaattttttatggctagctaatagagagaaaggtgggcaaaatacagagttataattctggcttttatggttggctttggaggagagggtttttggtttctatgacctaccttgaagaagaagaattctggttactatgactcacttcagggaagaatgtggagttaaagacaggaggggaggagaaggtcagagggaccttggttttgaggctgcttttgaggccttccagtgttctttagttcaaagtttcagcatgccaaagtgccatactttggggtatcgttttctgagcccctacagtgtgcaaacaagagcaatgtcaattcaacgcctagtagaaatctttctccaacataggcttcagcagatttctttcagctgtcatgccagcctagtaccttgaggcacgtttgagtttcagggacctctaagtagaagtgagcaatctttcttagagatagtctaaatcaaatgagggtgagactagagagattaagtttaaagcgtgaatttgaaagtgactggtggatattcctatctcatatttatgagtcagagggtatttgatgtataattgagtcagacaaataaatttcaccaaagtggcccaaatgcattatattaacaacccagttttcaaaatatttatggaagagtcagtgaaggattttattccattggaggaggaacaagaataaagaatagctctgaattactttagaaaatatgaagcgaaatttgtttctacaagtacttgaataaaagacaaagtagaatatacagttaagaggtctatgaaggccagattataaaggatcatgttgaaattttgttctttattctaagaaaaatgagaaagtctttgagtggttttacgaatgaaggtaacataatcagatatgtttttactaccgtatatttcaaagtagctagaagagaataatttgaatgtatctagcatagacaaatatttaagattatggatatcccaagtacactgatgcgatctttacaaattatacggatatgttaaattatcacatgtacccccaatctaagtacatctattatgcgtcaattaaaaaagatagaaatgataatttttccagtagtacataaaagagagagttccataaatactgcccagaggccaagtgaaaagctattgcggtatttttggtcacatttaatggcaacacagatttgggttctggctatggagacaggaagaagcatacatattcaggagacagagaatgtatgtgtgacagattagactttgcaatacattaaacatgggaaggaagagagagggttttagttggtttgctgtaacaaaataccataaactgggtagcttataaaccacagaaatttatgtctcccatttctggagtttgggaagtttaatatcaagtaactagcagatttagtgtcttttaagggcaggcttcctggttcatacttggtgctctctcactgtgccctcacacggtggaaaagaacactgatctcttcagatcattttaaggggactcatttcatgagggctctaccctcttgacctaattacctcccaaatgccccatcttttaatatcatcacattgggaattaggcttcaacatacgaacttttgtggggcacaaaattcagtccatagcggagatgaagataacaaatatgagggatggtgatgctaattactgatctggggaatactgatagagtactagtttgagggagaagatcaaactttaaaccttggcatataatgtttaaggagattttgcagcatgcaagtggagacatccaataggcagatggttatatagctgtggaattcagaacaagtgcctgaattagagatatacatatcagaatcattgataaatagattgcaattcaaggcatgatgactgatgtgttttctggtgagagatagtagagtagaagatgattggtaatgaactaggtcttgacatctagtacataatgatagggtggaggaggatggacctgcaaagaaaaaattaccaatggtcatagaaatagaaggcaaattagaatagagtggcatcatgaagccaaaggaagaaaaattacaaacggatagtatggtcaacagtgttaactgtagtcctagctacttgggaggctgaggcaggggaattccttgaacccgggaggcagaggttgtggtgagaccagattgcaccactgcactccagcctggtgacagagtgagactccgtctcaaaataaacaaatactagaaattggatggactcagatgcttgagcaaaagtaagagaataaagttcaaaatgtaggtagtgggaatgactttaattaaaagaagggaaactcaaatgtaaaagaagggaatgagaacggtggctacatatgcgggtctgatggtgtttggaaataggaagtgaaagaagttctactctgataattgcacttgtttctgtaaggtagggaacaagatcatctgagagagctgcagaaagaggatgggccagagctttgataaaaggttttaatagttcctgtagagacttagagcccaacttgggaaaaaaaaaaaaaaaaaaaagtatggcaggatgctaggttcatttgaggctgttgattattgccttagtttgggttgccccaagagtagatctgaagagaaggatttaggtgcaagcagtttatttggaaagtgatcccaggaaacaaagtagggaagtgaaataagaaaaataaagcagccaataaagtatggcacaaatatagggatcaggttactgctggaaggaactggggctcaatcatgcagggaaccccttgagacactgtgtatcatacttcaggattgtccaactgaggggcaagggagctgggaaattcaccaattccaagctctcactggttaagggacacccctaaagtattaacattccagcactccttctctgtccaatatactggcaaatagatgcttgcagatagagagacacaggaaattttatgttgggccaaagcaaaaataaaaatgttttaagacattatgatgataaatatgcataaaagatgattgaaatataattcactggtttgggtaggtaatcaaataaccatagtaggagagtatttaaggagttaacatcgctgaagagagtgtgaaagatttttacagcatataattgtactgtatattttaatcaacattatgaatgaagaaacaggaacctgatagtcaaacttgtggataaaaaatgtaggaaagataaaaatcatatatgacacaataaaaatccataaacatttgtaatgcatacacagataacttactgacattcagtgacatgggatttagaggaatcaggatccctagtctcttaatttcaagttggatagcctcgataaataacaactcaatctgtatgctatgaaccgtcaagtttctgacccatggtattgaggtcaattaacttaatttctctgaagctccatctcatcctatgggcagctggaattggtgatacctaaccaaagaattttgtgagaatataaaatgcgaatatgtttttctaagggctttgtgttccattaatttctgtatctgtttaatttttaaacaatagcctgcaacaaatgtgagaaattctaactggtttatatgattcaaagtcccaaaactggagttcaatagatcaggtcatatgtttgtgatagtaattaggttgtgatataactggtttaatgatagtttatgtgaaaaaattcctagaagttttaagtcaattgaattgcaatgtgagttgaaagtctaatattgaagtgaaaatatttattgaaatcatgggctatatcaatgaaagtattataaaccagaaagataattattcttccctgtttattttacacactgctgatatgttccctttaagtacccaatttaaggaaactaagataacaacaagccatagaatatccgttgaagtaattaagcatagggtaggctgatgatcaggtatctactgataaatttaaagagcggatttcaaatatttataattttgtatccttttgccaatatctttccaactactctccacccccaccagctcctggaaatgaacattgtcttctgtttcttttagtttgatttttttttttttttttttttagattccacttgtaagtgagatcatgtggtatttgtctttctacacctggcttatttcacttaacataatttcctccgggttcatacatgttgttgcaaatgaaaggctattcatagtcttaaaggcttaatactattccattagacacttgggttgattccatattttggctcttctatacctaaatcaccagattagaatgaataatttatccctggtggctccaaagatctcttccaaaaaaaaaaaaaaaaaaaaaaaaaaaggtttgaaaataacaggataggtgatctgatatttatggcagcataacaactcacaccaaaatgtagtggcttaaaacagcacctatttattatttctcctaattcttcaacgtaggcagtgccctttgggtatttcttttctctatgtggcatcaactggagcactcatttgtctgtcttcagctggcattgagatgggtcacagagggctttatttgcatgcctggtgccccatgcttcttcatgtggcctcttcacatggacagatcaagtttccttaaaacatgatcacctcaaggtcattgtacttcttatataattgttgtcttctcagaatgtgtgctctaaaaagtcaagctctgacatgcaagcacttctcaaaaccttacttgcagtactcttactattgtcccatttgtgatagaaagtcacgtggccaaacccagaggcagtatgattggagactacagaaaagcatgtgtttcaatggtgaccaccaacaggaattttttttttctcataaatactttccaaaaagaaaaggttatcgtgggaagtagtactttttcaaatagtggaaacattcaagcagaggctgggtaatagcttacaggatatattgtagaagtgatttttacattgaggtgaataaaatgacctctgtgatcataagactctagatcaaagctgactccaaatttgagtctacctaacagggaaaatagtgctgctattaatactaatagaggtgtcaggcaggagtctcagattgagaaaagaatgataaatgtggataaattgctttttttaatatagaagaaagagataatcaagaaataatgacttttattttttgctgtcttaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcacaggtttctgtctgatactctgtttctttatcttaagacagctttgatcaggcaggaaaattgagtttcagtatttcaggaatataaattttaaaagttcctgttatcatgtggttacctatgaacgatttgcattttatcaatagcgggagcatgacagactaaaagtgctcaaaaatgtacagtgttttataactggttttctgataccttgtgagtcccctttatcaacctgaactctcattttctgaaataacaacatcattcttaattgcctactaaaatgggacatgaaatgatttaccttgatgtttccctcaggctaaatacaatgtatatgtattaaaaatccttgagagaaatacataattacgatgatggatattcagtttaggtatccattaattttcttactacatcacctgtcggtttatataggttattttaaactcatggcaggctcgtgtcatgaacttgagtggtattaatccatttttaggctttcattaaaaatggctaaatattaccaactcttttttttttcacttgatttcttcatttactcctttcaaatgcttttagccagttagcatatcataggccattatcagttcaatttcacatattttaaaaaatgcaacttttaaacctaagcataattttttccttgtatattcaccatgtgttttattcatataattaacaaaatgcacttatttaaaagctgacttctgggggacctttctaatcaaaatgtccctggaccaccaatattgacattatctgggagcttgtcagaaatatagaatctcagaactagtaaatcaaaatttgcctttgaacattttccaggagtgattcctatgcacataaaggctcgagaatcaatattctaggacacaatcttgggctttacgtagcagttacctctcacattcttttagtatcactgcagttcagactttttagctgaattaacagattctaacaactcgaattttttccgtgagcacatggtaacgcaaattggtaatgaaacaaacaaaaaaaatagcctcctttgatcacaaggggatttgataaggtgtctgaaaatctggagcttctgtgaggttctcttgaaaccctccctatcaagtcgttatggtcatctggctttgggctcttcctcggatctgcacttgattaccctctttcagaatcaactttttaccaactcccgctggaaatcatcaagccagttaatgcttccaatttctcctatctctgttatctgtgtttactacccagagtataggtacctcgagtctatattttcttctatctttctctctctgctctattgcactttcttttccttgcttcacttcctctgctttcccacactctcactcggcaggctcaaacactttttcaagacaagccttctatatacttattctactcatacgtggaaaccaattttaccctcgaaaacagcactatgactcatccctcttttgtacccccactactttagaatgactgactccctcacctaacagagacaattccaaagatactgctctcttcatgtaaaaatacctctttccttgcagttaatgacttctggccatctcttatctaccattttatcatattttctcattgaagactttggcactaggttagtagattttttcaaccaatttgttctttcattcttagttatttcagcatccctgtgggctctcctgctatcactaaaagctgttgtttctctcatctcctcaattcagctacctgctgtcatgattgtatgtatgtagatgttgtcattgtcaggcattactccatttctttaataagattatttttttgagacggagtctcgctctgtcccaggcgggagtgcagtggcgcgatctcggctcactgcaagctctgcctcccgggttcacgccgttctcctgcctcagcctcctgagtagctgggactacaggcgcccgccaccacacccggctaagtttttgtatttttagtagagacggggtttcaccgtgttagccaggatggtctcgatctcctgacctcgtgatccgcccgcctcggcctcccaaagtgctgggattacaggcgtgagccaccgcgcccggcactaacaacatattttaacaaaaccagcagttcttcataagctttccgtgcatcctaagtatattttcaacttagtttctctcaacaattatttcaagcttttgtggggtacctaaactttccccatcattcacagtaaatgatttcatctcctactttagtcgaaataatatttctcaaattgtgggtatttgtgctcatagtatcttttttttttttttttttccacctgccttagtggaagaggctatccttcacctggttgaggctcatctctgggtgtgtgttctcagcagcatcactgactatgtattaagccacctggttccattcagctgtatatccagattgtcaaaaatctacatcccaggtctttatcattagcttttaaaccggttgtgttttcatcttttagaacgtgtcctctcctataaacatgcatgtgaatacttaacgtgccttatcttactcaatccctctgtagaactagaacctattaacctcttttccctcatgaaattctttcctcgcttggcttatgggatactgctttctcctgattaattctttcacattcttggccatttgttccaattcagtttttctttaatattgatattcttcagagtccttgtgtttcttctctggatatcctcattcattcccattcaaatagtgtctattttcaaatgaacccttctcccatatgtatctttagctcatctctttcttaaaacccagggtgatatatctgactgcctaatagacaattttaattgatgtttgcctgatatcttaaatctcattatttccccagacctcctttattctttctccttcctttcaccctgcaaacagcctaatccagaaacctgaaagtgaactgggtcacctagatttttcttctaccattcacaagtccaatctttgacaggttcaattaatcctgctcccttaacagctcttgaaaatgtccagttctctctattcccatcaccaaaaccctgattaaagctaatatcatggcttacttctatttaagatgacaatcctgtagctggtcttccctgctactaatgttatattcctttagaagtttccacatcacctctgccaaagcgaacatattaaaacctcagtatgatcttgttatgtctgtgtttataatcatttgagaaagataaaatcagctactgatagccaggagctggcttggcacttcagttaggctttggaactgctagatgttgccttggtacttgcagccagtctgatgttctctggttgaatataaataattgctagggatgccagcatcatacagggacacgctatggttgtgatgaatcaagataaaagcaagaccactttgtaatcatatcttaatacagtaaaaaagaatagcattgtccaaaccacgcctaatgaccaaatatccctcatcttcattaatgtgacacattatgcttctttactaaacacagctttagcctctctgcattcctcctgccatctagataaaaattttaggacactcaacatagaattaccctacttccttacaacatccaatcaaaacaaagccccacttccttgatgccccctatcatgtaacacaagcccacatcttaaaataagctttttctaacatactcttagagacagccccatagttccctgtgatgcgctgtctctctcgttgcagcgtgtaaatcaggttaactttgataacctacaaatatgttccagtggtctttgtctgaagagtgttgacaaagtccatgtcttcatattgccctcttaaagcctacaatgatctaatttttgtttacttgcacaaactaatttctagccattttcatttcaattccattgttggtttctagaaatcaggacttgaacgtgaagtggctttggttttatgtgtgtgtgttttgtttttggtgtccccatgcctaacacacaaaccaataaatgtttaactatatggatatgtgatttttttcagttctgcagttgcatttaagataggatctattaccaatatgaaggatagaacaacttctgaataaacatttgagtgaataagttactcttcagtcaaagggtaaaacttcattatagaatgttaaatgagtagattcttaattacttctaatgtcggagtaggactgatagagatccataacttattttcataatgttagagaagatacagaaagaggaggcttttaagaggtgctaataaagaaggaggaacagaggtctgaaagaggttttaatcaacttattgaggaatttgtgaacttccctgtgttgtattctttgcttcaaattattttacttttcttccttttattgaatattatataacttagttgccttttattttgcatttaggttacccattttagtatttataattcttcatgatctctaagaattttcatgagcccacaataatcactcatttctgatacattgatttactgatgccttttttagcttctgtatactttacttgaaattatgtgtactaaataatttagaatccgagtagtggcttctaaacatgtgatcatatattaagcatatattgagtaaagtatttagtattctatatgttaatagcataatttaaaaactgtatgttatgaaatatagatcctttcaagattaaaaatgtatatgcatgtagacacatatatgataaacagctctatagaaaaacacacatacagaaaagctggatgacttcatgaggacgaaatttaagagaaagataatattgtcaagggcagaggtatttttatgaacatggcaatttcgaggaggtaattgtagtttttatcagtactgaatgttgtaagaagcatttttcctaacaagaagaaaattaatgactttcttttctttttttttttttttttttttttcccgagacggagcctcgctctgtcacccaggctggagtgcagtggcgcaatcttggctcactgcaacttctgtctcccgggttcaagcgattctcctgcctcagcctcccgagtagctgggactacaggcacgtgccaccacgtccagctaattttttgtatttttagtagagacggggtttcaactgttggccaggatggtctccatctcctgaccttgtgatccacctgccttggcctcccaaagtgctgggattacaggcgtgagcccctgcgcccggccaaattaatgactttcacaaaataactttttgtacagtagtgaaggctgaagtctgactgtaggtatttggagtaatattgaaatactggaatttggactaatatggtaatattagtccaaatttcattgaagatgaaatatataaaagaaaatgaagactgtggttgaagagtattcagatgatacccttggtcttgaaaacatgggaaaggggtatatatacagtatgtatgtgtatgtacatatatgtacatacacacacatagagagaggaggtggaagatcagagccatgaaataaaaacagagaggtaagattctaccaagttttgactcatggattgtatatggtactctttcttttctacttaggtattggtttattaccagtatcaggacttgagctgaagaaaagatggatgtgcccaactccctaactaatatgcagtttctagaatactttgatttaatccatccttcctttactgagcttgcagcacctgtccccatgtactggttttatggccactttatataaagctattagagttcgttatgaatttgcactttaagagagcattgtgggtaaggggagagaccataatattgtatatggacgcgttacgctaaaatagagctcgccttattatgtacctataatgtaccagccactttcatggagacttgggatagagtagagaaggatatagataaggatacctgaccttatatagtttacattctagtgggaaagatggaaatgaagcaagactaatatgtaaagcatgtggaatgttagtgataagttccaaggagcagaataaaatgagagggtatgcatgtgcttgtagacagagtggcactaaaaggcctagctgaaaaagtggcatttgatgggggaaaatgtccaagtaagtaatttagggcctttttaggcatggggaaaaataaatgcacagccgtgtaacagcagcatgcctgtagcatcagggaaaaggtaagcgtgtggctgcagcagaaaaatcacgatgtttagcagcagaagaattcagaaaggttaaggaagttaattaagatcagaccatggtaaggacttgagcttttattcagctgtcagcgagttgagctgaatcctgttgtctctgtctgctgtgttgataatatataatcagagaacaaagggtgaaatataaagacctttagtatcctattttgaaacattcatacccctcagagatgatggggtactttgtctaatgtggtagtagtgagcaccatgataactcactttctggctatgttttgaggttagagccaacaggactttgtgatggattgaatgtgaggcttgagagagagaggggagtggaggattctgtttttggcctaaacaaaggaaaacacagattgaggcctaggacactccaaagtgcgagctcagggacatgattaggaacctgcaaaggagatggaggaaaggtgacctctgaagttggaggaaaactgtgttcaagtagtacgtgaagccaaattagcaaatacttctaagaagaaaaaggaatcctctcaatcaaatcatggtgataggtaaagtgagaactgaacatcagtcattgaatgcagtagcttgggggccaatggtgagactgataagagcagttttgatgggactgagtaagagaatagatgtgagagccagtttttgtttttgttttgaaccagtttttactttgcaagatagacctgtggaaggcctatgttcctctttgttgatacacagtcacttaaaatgaggacagttatcttcctttttcagcaaaatatatctctttagactttgtttttggtttttgtgcttttctgtgctttttaatgtatatttctgtgagttaatgggagacggtagaaattttaggaactactgatccaacctacctgaaaacagaagttcatatatttcatttgaggacgaacgtatgggtggccagatcccaggagaaatggcgattttcagtgatgtttatttacttaacctttttttttttttttttttaacactttttatatgtggttatttggacatttccacgaacaaggtactctcatcatctcttgtgtcaaaaatgtttccgtggccaggcacggtggctcacgcctgtaatctcagcactttgggaggtcgaggcgggtggatcatgaagtcaggagatcaagaccatcatggttgacaccatgaagcctcgtctctactaaaaatacaaaaaattagccgggcatggttgcgggcgcctgtagtcccagctactcaggaggctgaggaaggagaatggcgtgaacccgggaggcggagcttgcagtgagccaagattgcgccactgcactccagcctgggcgacagagcgagactccgtctcaaaaagaaaaaaaaaaaaagtttcctaaatttctttttaagattattgaagttacctttaagtagaatgagcacatatttcagtttgtcgggtatagtcttagcttatgtcaaaccatttttctcagcttaattattcctagctccccattttactataaaaactatctcattttgggaaataaatagcgagcttcctttaatcccctcagaagtcccacatggtaggtatctttattgctattttacataggaaatactgaggttcagaaaggtcgaagtactttattagggacagatagtaagcagtagagacagaactgataacagcagagcaaaaagggtgactgcaggcccttttgttgtagtatcttctttaacatctctttgttatactaaattttattatttttaatcaactatctacagctgtgtctgaaatgaaatgttttctgggctcttcactgtctcattcacactcttcaaggcatacttgtatgcatattcctcttcattttgcaatgttcctcttgaaagtaatgtgccctaacagaacccagatatcgtctgaacattgacaaatatgcagataccattgactgcttctttctggggtctatgtgtctctttatgcaccagttattcagtttatttgagctgtatacagagttggtaatcagcctatagactgtcagagaccattctgagtgacccggcattccttgtgatatcttgttggccctgctgaattaatagttaaatatgttgaacatccctaatacatccaaactataagctctgtttgctctgatatatattctgatacgctcacacctttttgaataatatccattgaaatacccctagcaacagcagagcatgtctgaaagaaagctgaaattataagtagaagagcagggttctaatattgaatctaaaacttcctaatatgatgacctttgatatacgatttaatcttactgatgctcagttttctcttgtataaaatggtatacaacaatgctgatttcttctttcttacaattattatgacatacatatggaaattatgtacataaactataatttggtagtataaggaatcttattttcaatgtggctattgcattgttttcaaaattttcacaaacctctctgtgcctcacttccctcctctgtcaaaatgggaaagtaatagtacctactttatagattattgtttttgttgtagttgtggtggttgttactgagactatttatattagaataactggaacaatgtggttaacaagatattaaaggtcaaatatgattcctgagatattcaaatataagttttgttctctgttagtaatattaattgattctagtaagcttagaataaagagattatgatgataacatttagagggctattgataatttattttcaatatttataaagaccacatagtgttctcattctactttttatatcatttcacaaaaactaaagcaaaagctcaatgtagataaaatagaaacccctctgataggagaagataactctaaaagtaactcaaagaacatcactttactcagcttgttgtcattgttcctttatgtgttgtattgtggtatatattttttctttcatctgtatattgttttctggataaagttcaaattctggacaccccaaatcctcctgtctttcttgatatttacattacatatttacttaaatgtgcttattttttctcctctaagatgctcagggtgctttccatataacatttaccttttaatggagaataaatgtaagtagtgaaaaacaagtatgccataagctgctaaggacagataacttagatcacaaaaactaataagttgagaaaatagaaatattggagcttcatctaggatcttacttttaactagatgttgtagctactctattttcatggacttttcagttcaaccaacaaattagaaccatccatgattgtgcacgttcctggaaacaattcaatactgtctttgtgaaactgaatttcaagacaactcagaagttttacctgctaattggaaagggatcctgggaacataaaatcacaaaataccacaaactgggtgctttgaaattttcaagtggaatgtaagatattaaaaagtgtctgtcactttcagagtttcttaactaattagacaaaactgagttttcatttgttgcccttcagagcaccatgtaaaatgtgtatctttcagctaagagataggtatttaagaaaataaaacaaaattactaccttatagattttttttaaattttactcttaatttattctcagttttaattagtattttatatattacagctattcctgatggagtttattctgtgaatgattggcttttttttttttttttagcattttgtactcttgatattgaatccagtattcctaattcatgaaacctttttttgtgattttaatagactccatttttagagtaattataggttcacagcacaattgaacagaaggtacaaaaatttcccatataacccggctcccacagatacatagcctgccccactgtcaacatttcccactagagtggtatatttgtttcaacagatgaacttacattgacacatcattatctcccaaagttcatagtttatacattagctttccctattggtgccacacattctgtgagtttaaacaaatttacaatgacatgtatttatctttagagtgttatgcggtgtaatttcactgccataaaaatcctcaatacttttcccgttcatctacacttctctcctaatctctagaaaccactgattgttttgtagtttacatagttttaccttttccagactatcatatattcggaattggaatctagggtgaaatcctgcggtaaaatatatagccttttcagattatcttctttaacttagtaacatgcatttaagttcttccatgtctttttatggcttgatagctcatttttaagcactgaataatattccattgtctggatgtctcacagtttatttatccattcatctactgaagaacatcttgattgtttccaagtcttggcaaatacaaacaaagctgctgcagcattcatgtgcaggaatttgagtggacatatgactcctttgtgtaaatgcctaagtgcatgattgctggatcatatagtagaatgtttacttttgtaagaaacctccaaactgtcttccaaagtggctgtgccattttgcattgccaccagaaatgaatgagagttcccattgccccatttctctgtcggcttttggttttgtcagtgttcttggattttggccattctaataggtgtgtagtggtatctcattgtttaatttgtaattccctggtaacatatgatgtgaaacatattttcatttgcttatttgccatctgtatacttcctttggtgaggtgtctgttaaggatttttgcccatgttttagtttgtttgtttttgttactgagttttaagagttctttgtgtatttcggataagaattctctaccagatatgtctttcgtaaatattttctttgagcctgtggcttttcttttcgttcttttggcagcatctttcacagagcagaaccttttaacttagtactattcaacttattaattctttctttcatggatcatccctttggtggtgtatctaaaaaactatcaacaaactcaaagtcacctctgttttctccactgctatctgctaggagttttatagttttacattttactctagagtctgtgattgattcattattaattaactttatgaattatatgaacaccacaattactttcaagcagttacacaaatttctaaattcagtggaaatgtatttatttttggtatgtttatttttcatttttattttattttttataatttcaacttttggattcaagagtaaatgtgcaggtttgttacgtgtgtatattgtgtgacactgaggtttggtgctgagcatagtatccaatagctactattttggaccttttcccctcactccctccccactctagtagtccgcagtgtttcttgttcccatctttatatccatgtgtatccaagaaaacatggttttcaaccataatgctgtgttccacaaaaatatatgttcatgttattttattttatttatttatttttgagacagagtcttactctgtcacccaggctggagtgcaatggtgtgatctcggctcactgcaacctctgcctcccgggttcaagggattttcctgcctcagcctccagagtagctgggattataggtgcctgccaccatgcccagataattatgtttgtatttttagtagagacagggtttcaccatgttggccaggctggtctcgaactcccgacctcaggtgatccacccgcgttggccccccaaagtgctgggattacaggtgtgagccactgcacccagcccatgttatcatttgtacagatatattcaatgttgaaattttaaagtgaatttgtgataaaattcacaataatgtcagatatttcaccatcaaaagtataaacttccaatgaagttgatccagtgaataacatgaaagtaaataaattggaattaaataattgtaattaaaacaaaagaagggtgtaaggtttatgcctagataaacttttttgcatgtagatgttgtgttgttcaggaccatttgtttaaagactttttctccactgtattgccttggttcctttgccaaaaatcaattgattatatttatgtggatctgtttctgagctttctattctgttccattgatttacctgtctgttcttttgccaatattactctgtcttgattactgcagttttatatcaagccttgaagtcagatatcgtcaggtctcccacttaggaaactctttaaaataaatttttaagaaaacctttattcaggccaggcacggtggctcacacctgtaatccccccgccccaccccagcactgagctgggcggatgatgaggtcaggagtttgagaccagcctggccaacatggtgaaaccctgtctctactaaaaatacaaaaattagctgggcgtggtggtgcacgcctgtaatcccggctactcgggaggctgaagcaggagagttgcttgaacccgggaggcagaggttgcagtgagctgagatcatgccactgcactccagcctgggcgacagagtgagactctgtctcaaagagaaacaaaaacaaaaagctttacatttgtagctatttctttaaattagatagtcttttcagatacataaaaatatgtggattattgtataagcatttacataatttaatgtgcttagtaaatagtgttgtctagatgattactttttctctgcaactatttctgatattgccatattatatgaaagagtttccctctgtcgcccaggctggagtacagtggcgcaatgatagttcgttgcagcctactcagactactgtgctcaagcagtccttctgcctcagattcctgagtagctgggactacaggctcctgtcaccacgcctgactaattttttaaaattgtttgtttagagatggaggtctctcgattttgcctaggctgatctcaaatccctggactgaagcagtcttcctgcccaggccttctgagtagctcggattacaggcctatctcttaactatttgcttttaaaggaatgtattagatctgcgctgtacaatcacagttaacactggtcacatgtaacctttaaattttaaattatttaaaataaataaaattagattaaattaaatattcttttattttcaagtcatgctgaccacctttcaagtgctgaatacccacatgtggttattggctatcatattggatgacacagatacagatcatttccatccctgcacaaatttatactcaacagtggtgcagactgtccatgtatctgttatttgccctcccatctgtactccagtattttacctggaaatatttttttaaatgcctgtggatgtaaatgaagtcttaaaaaatagtctcatgtagaataaccttctgcctcaaattcaagagaaatctttgttataatatgattgttaagtcacaggtgtgttgttcttactatattttaattgcgttatagttatttgaatagttatgttttaggacatacacattgttatagtcaacacttcttgatgattatagtaatgtagttctactctgtcatagtttaaaatttatgtctccataggaatattattagctaaactcaatagtatgaaattctggctattgttaactgaaataattttgcatttgtggttcaaaatgtaactcttaagggaaataaaggaattcagaaagttttttgaaactcaatcttgtcttccttggaaataggagtactttgattatttttgaaagaaaaattagcctacagcctggtatttaaatatatatgtacatatattatatatttctgctaaattatttatggtagtttattttttccatcttatatacatactggattctcaatttgatttttaataccgcctatatacttattagtaatttcaatggtgtatctttaaaagataaatttcattttagttatgtgacactttatctttcattgttatgaattgcctttttactttttgcagtcttgcgttgaaatgtatcagaaactataatgtaaaaaaaagctgagtagaaatcttataattaaaagttgtagcaagtcatgaaaatggctcatgcttttattgccattttgatgtttttgatggcaaaagtgttgagaaaaagtctttagattcacgtgataagctgacagagtgaaacatcttaaggcttgaaagggcaagtagaagttataattattgtgtagattcacagtccttgtattgaattactcatctttgctctcatgctgcaggccatagagcgagaaaaagctgagaagttcagaaaactgcaagatgccagcagatcagctcaggccctggtggaacagatggtgaatggtaattacacgagttgatttagataatcttcttagggatttgataaacacataggttcatatttatcagctgaattatatcagacaagcacttgttaaatacaaatttaaattaaaaggtgtttgtatgttttttattattctttttttaatgctaaggaaattattaggagaaattcaactttgagttcattggaagaaaatgggatgtggtagaatattttatcagtctgtagcagagaaataaattttaatgcaaatctgctagaatttatccaaataatttaagaaaataaggttaacagaaatttgaaaacattaacagtcatgttatatgtgtaaaactgatcatcatctgattttaaatcatttttgcaatatgtttttccaaacactaaaattatatggaatgttttaccgtcattcctgttttgtaataatatatatgacattttctgtgttactttttatcacttcctctcatttaaaaaagaagtctcttcgggataacctttacttttaagtaacttttttagagtgagataaaagcacaaagctagccaagtttttgtctttctttttcaagaataaattaaaattaatcttttctaatactcagtgcctcaaaagttatgtgtaccaaatgtgtcattgacatgatatgtaaacaaccttctttcaaattatcattgctatactactatatttccagataaaattttacgaaaatcagggataatgctatttccaaataagattatttttcattttgtagaagacgtttacaagaacatcataaataaatacaacaaatgtttttgttgtgcatgtcagcttttttcagaatctgcctgcattttggggcataaattctgtgtataagttattttttgccttaattgcaaatttggcattcaaaagttcagtggtcttcctagaaaatcaattcattttcttcttctaatgagtcccatgactgactgtatttggttaaaaatgaaaacaaacaaatataacaggtgagacttgagtgaacaagtttaagaacaggtaatgaaaataccagtagatttttatttagatgtatgttgcttggtaattttaactgatcaacttaacagcatattcatgttaaataaaattatgtgatctaaaaatattctcctagttgttatgtaagttccccctagaaactgtattatcactttttcattttaataagctgatgcaagagctatactttaaatggtctcatgtcatagttatatatcaagcttacctacactgaattaatcagaaataatttaaacatttagaaattacgggaatgatttttaatttttggtaagtaaaactacatgcaggatttaaatgatcgtgtgactagtgagaatattaattttcttgattatttccctcatagttctaatttttggaggcatgtagaaaagtcaggacacatagtaggtgcttagtaaatattaattgaccagattctgtttagaaaagcaaaattaaggcagtcgttgaggtaataacgttggtaattttggtgtgaaaataataatccatctgaaggaaaatgctaactttggcagataccagggaacactggggggtaggggtgtgatttgagacattcctgtttggttgactgtgttaatcaaattttatgctacccttttgttctaccagtaaagatatggtcgaactgatacgtcattaggctcaagtttgggccataactaggatgactacttaaaatgaccatagctctgtttccccattaaataaaataatttatgaaattacttaaaggctcaaatattctaacttatctatttgttccgtttttgtcgttcaaggaacaaattgcataatatttattttctgtgattgtgcaaattgtgagataagctagacacatattaagtgcctgaagtaccccttcaggtgtatttcagagggactgctaccctaaatcataatagctcctttagtatagagcccaaaagtacagttgagtggtgtagctcatgaagctgaaagacaaatgaagctttctgtaaactaggagtccagcaattattgcattaaagctcttaaatttataagtccagaatcttccttcccaagcttaggctatggagatataataaatctcacaaccacgtaagacacatacattcttgccctttttgtatagaaaggaaaatgagagctgaatcagtgtgcttcatttaggacctcatgtaaatggctgttcctcttaaccacgtatagtttcctcagaagttaagataaagatgaaccactcttgtataaaccactcatattattatgccactaataaaaatatgtgcgtatatatttataaatttgatgtgtgcttaccacagtgaaaatatttaacatatattcatagtgtaaaaatatgtagaatagcataagtatagctattatagattttaaaaaattctgtgaactatattttatatgtatctatactggtatatgcatagcaaactgaattttctacttaaaataatttgccctaagattaaactactttttaaaaatttagaataattttgtaattcatcagtttgcttttagaatgaaattccaagatggaaaaaataatttctcataacttaaattttacttcagttttgacctgaaatggtacatcagacatatttccaaatgatttctgtccgtttctaaatgtctatgaagcattgaagattcaacatcacttaagtaatgcagaaaacaaaatctgtttgtcctgaaggcaatttgttgaaggaatttaagacatatgctgagaagacaggatagggtgttaaggttgttgaaagtacaaaatttaccatggttacaatgtagaagggaacctcatttgatggtgcaaagtattgttaaaaatcagttgtacgttctagaaacagtatgtctagtaacatatgtacagtttttcagtgtcacatacaagttttatgatcaattggaagatactttttattttcactgtattttatcaaatgtgaagagttgtatgcagaattttaaaacagttaatattaaccatatcattaattttacagcaataatttgtatattaagagtttattgaccgtaagagattcttactaatttatttggaatttttaaccaaagaaatgagttggccaaattccttgcctgctttaaaactatacatggacgttttccttatggatgttccagttcttttggtcagagtagaagtgatctttcacgatcatagactaaaaagagaagctactaaaaggagagtgttaactaaaaaaaaaaatcacgtttctggcattttggcatgaaattttggtataatttttaactgatttatctctatcttagctgtattttttgtttgaactaacattaaaattaatttactgttcttatgtcagcattaattggttggataaatgtgacagaatattggatggtgcaaagtacctctttttactagagacatttttggatagctgtaattttcatgcagcttaccgtcaatatgtaagctttggatcataaccctggtctcaggaaactgttaacttaatgagggcaagtgagaggctagaccaggtatctagtgatgtatttatatattcatgtagctgtgcatattgaaaagggagtttccaaattctttattttactttttaagaaagatgtgatataactttaaggtttatttttacatttcttaatttaaatacaaaatgttataaataatttagaaatttagaaaaatttagccattaaatatagtaagtaatctttctaatgctttaataatattgctaactaataatggttttctaagattttaatttgaacagtctttaaactgatgcctttcatgaccaaggcctttcagtgtattattgagattgtggagttttaggacaacctagggctaaaataatatacatatgattatacctaaacatatgtctgtttttatctatttaggattagacgtaatcctttttgtaaaacagtgttctcgcatgagtacatacagtctcatcaatcaggcataacacaaaaaagcctagtttagataaactggttttccatattaatactgaaattaccaaaagatgaccatatcaaaacatttatttgaaaacatatgtaggcgtagctcaggttctcgttctttagtctctaagatcctttcaccataatttctagaggagatactataattatgtaatagggttagttaaattgtgattcattttcaatttctatttgtagttttctgtgtgttaattaagagtctaaggacagtcacatcaaggacatgtttaaataaaagtagtaattattagtatattagactaaagaacatctcaaaactatcattccctgagtgctagattatagtgtttaaggtgatacctgataataagtatgctaactgttgtaattaaatggcacagaatgataacactgacgagagctcttcttatccataacattaaccaagtaactatctttttttcttgtattttggttcatagctcattagataatttcacatgaattatgttatttgaggtgggcaaccagattttgtcagatgggtgagggtagggattatggtcagtctggctcatctcaaagctaaaactctcatgatcactggaaaaactttcagtagcagcaagtcttctaatcatatattttaatggcaagacatattgcaaatagtctgtatacaaatgtggcatggagactgtaccacttgtagtagcccagccccttcatcatgaatgagtagccttccacagttgcatatatttcctcttctcttattccttcctcagtactgggcagtttgatttatatttcttctttctccacatgacacttagtataatgctctacacagagttcacattcaataaatgtttttaattgacaggcacatttttcttcgtttaagtctaatctccaaaaggaagagcctctgtgggtgtgtgtgagcacggcgtgcatgcacgggtgaactcgcatgcgcagacatgtgcgtgtgtgtgtccatgtgtgtgaaagaaagagactgttgttgtcactgttgttgtgggaaatgagtggccaaaacaaatatgagtaaaaatctgactttttttaattttatgatgtttgaaaataaaaacgcaaaagggctatattagtaaaatttatattgccctcactaggggtattacttttatatatactattaatttttaaaagctattactttaagtcagtgtggtcacagaaacctctaaaatttagcctcagaacttgtcttcacaggttttgaatatctctatattacattttagactattacattgaatgctaaatggacttgtaataaccctcacttaaagttcagcaaaaataggagactgtttattagcagctttattttaagtttctattccaaatattcttttaattcaagagctctggaaacacttgttttgtgttattctaccctggcttcatggctaatgatgaatatacttgatgaggaatacttcactttaagtggcagttctgaagtacttgcatggaaggtggtgcacatttaacattattctaacagtctgttatgcactgtacacaagtaataaaattaatggatacacttcaagtaatgatccatttcctctgggtgcaatatatttattcacagactatttcaggggttgtttagaatatgagatgtgaatggattatgatccattatccctgagattctaatgtgctacaacaaaatggtttccataagtattgctcataatgcctggtgtgttagtatttgtattcttaaatagctaacacaaaattagaaaacagatgctcagatgattgatacttaaaacttttcagatatttacacttacaaactcttagaaaagttaaaattttccattgagtcaaggagcataattctatggaatacatataaaacaattatatataataataaaatccatatgcaaatatttacttggataacgctttgaaccctttttcattctagaaaggttttaatggactttcttagaaaatcaacagtagttctggcatttagatggtcaattaattcataaagttgaagtaatagcatttctcattttaattgaagagaggtacattaagtaatgtgacagtgtcggttattaacgtgacagtgtcagtaagtaacgtgaccatcctctccatcccctgcccaagtattttaaagcaaatttgatacaagagagattgtgtgcttgtttgtgtatggcttttggcttcagtgtacattggtctcataatttttatattcatatagagtacactattgatttggtattgaatgagttcatgagtacagtgtagttatactctttctactccaagctgagaattctattagatactgccagtggagacatttcctataggagtttatagtttagaaggacagtttatgcccttgttgagcaggcagcatattcacaatgaattaatacaatgtttgcatacaaatccttcatagcaagacttctgattttctgtgcccaacattatgtcttttctagtaacatctagaaatttccacgttttttttgaaatgttttcgtttctttataacttcaatctcacatgattataaatgtggcagaatattccaggattcccaaataaactctttttatttttattttagttggtgacaggctcttgctctgttgcccaggctagaatacagtgatgcaatcatagctcagtgcagcctcgaactcctggtctcaaaggatccctggttattgataaaacttctttaaaaaatgtataaatacaccttctatatcccatattagtcatatattatataaaattaggactaattttaaaatagtattattaactttttatacatgtcctgtttcagtcattaagaagacttcctctccccctaattttcacacaagagagctggtcccttgttttctgaatattctttttcatttcctctatatggcattgtctaatatgtctttgttgcctagtatgtgtcagcatttgttataagtaagttatatatgttaactcagaactttggtaagtatcctatgaggtcgattctatttttaatcctcatttcatggatgagaaaaacaagatccagtgaaattaagtaactgaacccatttcacacatctagtaaggggcatcaaatttgaactccggtctctttaacgccagaattctcaccggtcatttctctgcctttctgcctgcctccccctttttgctattatagatgtcgttcttttacctatcactgcattttcattgcctgcattcagttataaagatcaatatgcaaataaatagagcgtattataaatttcagtgttatgaatttgtacaaagctgacttttcttcaccatttaaatttcttttacagtgatatattgcaacattttttggggggcaaaacatagagttttgtgtaatgatcaacaatgactcattaaaacctgtccctagattttaacggatactgcagagcctattggtacttcactgtagttttatcatttaacaaaattaacatatccatattgaaaatcaacttatagtttcattttttcatttgctacgatttgtatggttgacctttctcagggacacaaagtgatttctctctgtgttcccgtctcatttagacaaatgttgaataagactcaatccagcatcagtctatcggtccctttaatttagcatttcttttttgcctgtttaatacctggttcatgttgacgtttcacccttcatggacttctaactgcttgttcaagttcaacatatgctgaaaatatttctcctaaatatctgatcatttagatccatgccacattttttgttattaacataatttaaaaattctgtccagtatattttctaattatctttttattttccagaaatgttaacgttttatcataatacttttttcaaacggagtgctcatacgattgaagtttcatattcttctcttacactttataccaaatgtggtcattttataacaacagttacttaatcgcatcgcttaacaaatattttggtacaatttttgatcactcctcaaaatctaacgatcaaaaacagcatgtcacaattgcttccttaagcattaggaggatattagaatatgtagctcctgtaggccacggacttcttttatacttagatatatggagccatgtatatattctttttacattctattatttccattgtatctcattaaaaatatatcagggaagaaggaggggaaaatagttgacgataatatttgcaaagtttgtctccttcaccgccatcctgagtagcattatgctttgaaattagtgaagttacagttgtgtttcaaatgaattgagggacatggtttggcagcattaatatcattatgacaaatagaacattagactatcagggcagagggaagtgaaagaggataaaataatatagttgttgaattcacatctatattttttttagtctttaaaaaggataaagtgggaggcatgtgcaagttagcaaaaccacaggccttatgtttctagagacgttcttcagactttttaagaacttagcttccctttaactaaattatattaccagaaaattaagtaaaatgaacatttataaaagtagattatcttaggcaacctactcttctaccaaactactcttcgaacttttaggtattttaacctagagaaagaaccttacagtgagtttatgttcttttgagatctctgtaggtacatgagggaacataaaacatttaaatattcagtatttccaaagtataagaaagttatcagtgctaatgtagctatgtttaaaaatgcatgatatcatatgtaatatattttctcttttatattctgtcattaagaaaactatataagctaataaatctaagaaagtctaaattttgtaaactaactttagagagtttgaatattttaacccatagcacagcgtgatgttgccatgctttcatgctatgtatggaataatatgtacttggactggcgttcgtcatatatgaaatgacatagcatattccatggtacatagtaggtactccagaatggtaatggtgataatgatatgcttgtgtttccatttttcccttgataaagttttctgggtttggtattactacagatgattttaaaactttgagatcaacttctacatttataaatttaaaaatgtttcacattagaaagattatttttcctagtacttgtttttcttcctcgcatccatggacaatatgagacagagtctcgctctgtcacccaggctggagtgcagtggcgcgatctccgctcactgcaagctccgcctcccgggttcacgccattctcctgcctcagcctcccgagtagctggaaccccaggcgcccgccaccacgcccggctaattttttgtatttttagtagagacggggtttcaccgtgttagccaggatggtcttgatctcccgatgccgtgatcccccacctcggcctcccaaagtgttggaattataggcatgagccaccgtgcccagccgacaatctgtttatttctaatcttctgtaaatgaaataaagaataatcttggattttttttcctctttttaaaactatgaaaatactatttaaactaatttccaagcccatttttaaaattaaaaatgtaagttagtttggggaagtatatttgagtaatatgtatgatatgtaaaatgtatctgaaaacatccaaaatgttacttgttcatgcagccttccagctcccatcagagctttgagcacttttgtttttatttaagtttttatttaatattttatttacatatattctaattttctacatcttatgtcttattacttgatggcattgatattcattgttgtgacgcaagtctgataattcacattgaataatctgaaatcatatttacacatttatatcttagaaaataattgatctggtttgaaatcattcatgtggtgaatacttttataattaggatgtgttggctttcagatcatttctttcagtctgtgggttcaggggatatatttaattatttttttctttctagagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggtaagaatctcttctccttccatttggagcataatcaataggtatttcttggcaatttccaagaagacagtaacaaattatttagtaatgaaacgttcaccttctaaggatttagctaagcgcaataaagttcaaaatgtaagcaacagaaatctgtttaaatatgtaagacgtagatacccggattctaaaattgtatttggcgtagttacacagcgctaattgattgtgtcggtttgcgtaagcatgaggcagtttaggagtgtggaaaccacatgtatcctgtaaaaaatggcctctcactttggaactctttctttgtgacgagtgaaacatagtcattttgaaaaagtggaatccatggaaatagttagaaacacgggtcaacaacaagcttggatgcagtataactagatacataaggaaaatatttaaaactgatggacctctcaaattacgataatttgaggaaggtttctttacaaaaagatatttttaaaatgtagctggagtacagaggaaccacaccggatagtgtagtaacccagcatcagagttcttaccccttttagtccagaaaggatcagtgagagagcagttatagaaactcagaaggagacagtcagatcctcatggtaaaagcagcatggccggcttaaggaatcctcatagaaatggagtcagacaaataaacaccccacttcacttttttccctgcctccagaatcttgtcagggctcctcactgactaaacttaatcgtaagacaaaggacaaggaaccgtcatctgtaaatatcagtctcctgggtaacaggagaagagcggacagtggatctggaggggcaaacaagatgtaagtggacaaaagggcctgagaaagagatgaaaggattatgccttcaagtgtaagaaaacaagagctgtataataatgaaaatagcctaaactgttttcattgttactatgagctatgtgcttttcgcggggaatgagaaactgattagaggatggactaaaacgtttccaggatgaacgtttagtgatagatcgagatgattacatttaatacaaaaggcaaggagtggagattcatttgcatactgtaaaaaagaatggcttaaataaaggtagaatagacatggaaaggtgacaaggttgatttagaaaaggtattggacccaaaaagtgatgagaaattcaaagctattttgaagagaaaaacaattgaaggacttaatggttcttcaaatatcggacctgtagcattattaggttttctgttcttgtgttagtttgctgaggaaataaactcagaaagtatacttttggataaagaataccttggataaggcacttgacttgttaggcaaatacacacatctaaggaatttctacattgagatgcattttgtaatttaagaatagaaccaatgccgcttttcctgtgaatcagaggaataatccaaatacattatttcttgccacaaaaatctgatgttaccttatccgattcttgagattcagatatagtagttagtaatagtacctacacagtacattcatgcataaaatatatacattaagtgtctctaatgtgtttaagaatgctactgagtgtattaatcagctgagtctgccacaataaataccacagactcggtggcttaaacaacacaggtttattttctgagagttctagaagtgagagaaagtccaggatcaaggtttggtagggttcagcttcatcttctggtgaaggctgtcttcctggcttgcagataaccaacttctcactctgtcctcacatggctttcctctgtgtgtatacatgcagagagagagaatgagggctatttttctttctctctctctttatctctgcctccttttataaagccaccaatccctaagggattagccccccaccccgccacccttacccaaccctgatgacgtcatataaacatcattacctcttaaaagtcctatcaccaaatagtctcaccaatggttaggacttcaacatgtgaattttggaagacacaattcagcccatagcactaagttttgggaatattagagtgggcattcatggactctgcttttattgtatttacggaaagcagagaagagagatatgaaacaatggaatcaatatttttaaatttcctgctaggaacagtggtttaaactaagatgcaaagctttgggagaatgagtaacagggaaaaacgaacctgatacagccaccaagggcatcttccttgagggaggaacatttgagttgagacttttgtgataagttagaattaggtaagagaacagttaagcaagattccaggcagaaggaacatggcaagagggagcaataaaggccaagcacctgaatgaagaccattgtaaatgctgaacatagaggggcagatgaatgagaggagagacaaacaggaatcagtcaggtatataggagacaaaccaatgacttctgggacctgctagtatcttggtcttgatttgaggaacaaatggagatcaccagaggttttatatattaaatattgtctggaggttgaggaagtcatcctaagggaaaatacttctcttactgcatccaaattccgttgtcacctccttatcaccccttactctttctctcagacccattggtgtctattaatttgaagaatcactttaggtaaaatatttagcaagataagcttaatattattcatacaagggcaaatatatatactgttctgctgagattagtgataggtaaataaattataacatgtttctcagcgttttattttatttggagaagttttataacattagagcgcatatttagctcatattctaatgatcggcagaactggtttttaatattgtgggggttagagagccttatcagaattggaaaaaattcatgaaccctttcctgtgaaaaatacaaaagcttccatgagataagcatataattttaaagaataaacagactcaaaggagataccatactctggaggaccaactaaaccaaatccttttatggaaataatggctaattgttcacatctttttaaacacagaatacttcagttgaaaagtatctcttctatgatttattctcagaacattaaggtctcaactgaacatttgcccaaatgttttattagtttcaaagtcccctttgtttttcagagcacacttggctataatgttggctctttctatagccccctgaacgggaaaaatggcagccctccatctggccaaatataaatcaggttcttaatggttcacagtagatgccaatgctgccatttgtaaatctagcatacaaattatttgtatatatttctgtactataaatacagaatattaccctttacctcttgtcttatttcttatccatggatatataccaactttctagcactggtttgagaggatttatatttgaaagagaaatataggtcaccttccattttgctaaacgtctttaatcttcacccaccaaaacgattgaatcgtcagagattattttacctgaatcagctcataccattataaccacataaacacattcctctgaaagctgtatttatgtttttttaatgagaataagtggcattgtacattagtcttgcaaccatgacagaatttatgtgataaatttctcagcctctcctaatacaaaagttactctctcccaaagagtatgaatgcctccataaatattaactttttttttgccttttcactttgattttcaggaagctcagatttcaattcgttcagaattggtataattctttccattttctctttcttctaatgggctcatgttccaatttttaaatttcaattttcctgttgttacatattaaatagtaactaaccctcaagtatttttttctaaagacagcatatatatgaattgtaagtaagcagccatgataataacacttttaaaaagggcagtgaaaactttgagttcaaattatatatgtattaaatacgaaacaattccaacttcactggaaacaagaacatgaaaacatttatgtagagaatagcatgcccttcgcccactttttgatggggttgtttgtttttttcttgtaaatttttttgagttcgttgtagattctggatattagccctttgtcagatgagtaggttgcaaaaattttctcccattttgtaggttgcctgttcactctgatggtagtttcttttgctgtgcagaagctctttagtttaattagatcccatttgtcaatttgtcttttgttgccattgcttttggtgttttggacatgaagtccttgcccatgcctatgccctgaatggtattgcctaggttttcttctagggtttttatggttttaggtctaacgtttaaatctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgtcctgttggcttaggattgacttggcgatgcgggctcttttttggttccatatgaactttaaagtagttttttccaattctgtgaagaaagtcattgtccaaaagaaatacagtgctagccacaaattcaagccacatatgtaatttaaaatggtctagaaactatattaggaaaggaaaaagaaacggtaattgaatttcaatagtacattttatttaacctgattcatcaaaaatattatttgaaagtgtaatcagtatttaaaaactttgagattatgttcttagcttttcttaatcttcagaattaaacatattttggtaatttcatgcatctaaatttggaccagccacatttcaggtgcccagttgccacatgagctagtgacagtacagcagtgttcatgtgattttatcatacaaaccagggtactactgagagtgaaacagggtgctactaataattatgccaggacaacaagaggaaacctggacagccaccgtaatttaaaaagtggcaattggctgggcgcggtggctcacacctgtaatcccagcactttgggaggccaaggtgggtggatcatgaggtcagcagtttgagaccagcctggccaacagtgaaactccatctctactaaaaataaaaaaaatttgctggacacggtagcgggcacctgtaatcccagctactcaggaggctgaggcagaagaatcgcttgaacctggaatgtgaaggttgcatttggccaagatcgcgtcattgcactccagcctgggcaacaagagcgagactctgtcccaaaaaaaaaaaaaaaaaaaaaaaaaagcagtggttgcctgtttggtcaggagaagtaatgagaccatacaaaacatagaagattatagatatatttttatatttgggtgtgtacatacatatgtataagtattatatagattttatatgtgtgtatataatctatataattgtatcaaaatatatttataattatagtatacacatatacatatatgtaggtatatatgtaatttatattttgcagaaatgaaagagaaaatattgttcattgagtgagcttaaaatttgaagcaagcgcacatcattttgatataagaggggtgcagccaaacacctatatttgatttatggaaaggatttaaggtcatgcatagtatttttccactgtacgcattcatacccattaatgctctaaattatgtcatcttgaaatttaaatatcattatataggatgatacatattgaacaaagagccaaggtatccttaaatgtatggctggtgatagaggcttgtctatactgtcatggatgtttcttatcagatatttgtgaagggtattaagctaaacttgccttactgctttttaataccttcttttgcaaaatgtaatgtatgcaaagtaaacgtgttacttactttccatactctatggcacaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaagtaagtaaaaagcctaaaatggctaacttgacattttccaaaatggttatttgtggggaaatccagaaggtactaacatgaaacaataatttctgtaaatggaaccattctccctacaacctgtattaacaaggaacgaaatactggtgtaacagataagctgtctgtagatttttttgtcctcataataattttgtgactttgagaaacaaaacatgttttgtatgggaatagcttctccttgggggattgtagatttcaaaatcagatgttttgaatatagaagaaaataaaagagcagttgaggtcatatgaatacacttcaattaagtctggctcgctgtatatacaaggatatttgctaggcatcttctaatatttctgtcaatttatctgaagagtattatagctttagcatacatgtggcaactgaaactcagcaaaggacaaattattctttgggctacattttactactggatcactataattacataaatcctattttttcctttgatgataaaagataaaagtggagcaattatgcaaattcatgccatgcgactagcaaatttttcaagatgtttcttttgtctcttcctgaattgctttaataagatgatgttaatacatagtatctgctccaaaatatctctactcatcaacttagttttaagacaaaaattcttttcagagacagatgaatgaccacctttaagaaatagtaaatggggttttgattcactatatacatgcatatatgtgttcatgtgcacacaaaaggaattattgagtaaaatcgggtttgaaggcattaagataaaagtatttttctgaaaaaatctctgtcccaaatttgtcatgagaagcacaggaacatgtgtttgtttactactaaaacttaaattagttggaaaatatattatcctattgcttttctttgtaaatatttaaagaattcaccatataatatcatttccagaattaatgtagtgatacacaacgcttttctcatttcccagcttttcattttttacaaaaatgaaatgagctaaataaagcaaaggataaatactttttttttttttttttttttttgtacttcagagtcgtttttgctaaggggtttattttcctgtacaggtagtaaaactttataaatagtatcagctccctctagtggatttcagtatacttgttactgtgcctctgcaaaatcaatttgggaaaatattttaaatgtcctagattttcaaatattgacatatttaacaataatgtattttcacttgtcattacatacataactcccccttaaagttaaatacatttagtggctatgcagcaattgttgtgcaaaggagccatttcactggaaatttactttaatctgtatatacctcttaatcatattaaagttcaactttttatcatttactttaaagatgttcagaatagcaatgtttgataactgagatttgtctatgatgttacaatataaatacgtaataatatatagtctctattcatacagctctccatccatccatccatccctatcatctttcttctcttttttaaatttcatacctacaaacgatgattgtttataaaacttcctaactttttcactgctattatatgtaaacaaattgtccccacttccactgtagctacacatctttaattttactattcacccttttggaatgcttgtctagattaataaataaccctttaattaaatatggtgtatatatatatatatatatggaatgaaaaatgtagcatatgaaattacatagcagttgattttgttaatttgaaattaattcaaataattgcacatgtgtatgcattatatccgaactggcaccagggagtaaatctcatttcttgtattcctccacagtactttggacgtattaagtatgcaggaaataagagctaacagaagtgcctaggcatccatactgacttttatttcctctttacttttttaaacttgctttttcacacaaaaacctggcttttaaaatatactatcagtgttggaaaatggcataaggaattggtagttgttacctgacataagtgatagaagaaaataatataaaaagataaaattctattttcaaagcactttttactctatgcataactaatttatacatcattttacctaaccctcagagagaaacacattgagtatttgttattacaactatatcacaagtaagctaatggggtttgaataactaaaagcatggatatgggatgctgtaagaactagatcgtatacacgaatgtccataacaacattattcataatagccaaaacgtagaagaaacccacatgtccatccagtgatgactatatgaagaaaatgggcacatccatacaaggcagtgttactgagcaataaaaagggagaaagtactgatacatgctacagcatggagtacccttgaagacattatgctgagtgaaagaagccagtcacaaaagatcatatgttatatgagtctcttgatataaaatggccacaataggcaaatctgtacaggcagaaataagattagtggttgcctaggtctgggaggatgagggggtggaattgtttcccatgacagttgataaaatacttttctagagactgaaaaccagtaaactcatgttatatgctagatgaatatagaaacacagcatctagtctgttgtagataattgtttcaacaaagaaaaaaatgaaaccttatttcttaatgtaaagaaggaaaaagattggtcatataatttgagtttatttcattaacaatttggaaatcatgttaaaataattattagggattttattggtttggtttagttttgcaaaaatggagaaagtgacattattagttatgacaaagccagtgttttgactgttctaaagtttcaaaatgattctcttctgttctacaccattagattgctttcagaacagagtcttgctcactttttcactaataaattcaagaaatatttttgaacacctggtatatgccgtaaaagtgctgggcactaggtaatatacatggtggagaaaatcaagagcaatatgtcttcatggagcttattgaaagaaagataataaaattgaatatctgaatattattgcagattataattactttggcgtctgaaaccgtgattctggggagatgatgttagaaccaaacctggagaatgtgcaggtgccagctatatgataagttggagaaaggacattaggagaaatgaaaagaaacacaaattgccaaaggtgaagaatgagggcttggcatgtccagaagacataagggaggccagaaaggctggaatgtaacaaatcaatgaaagattaggacaagatgagggtagaattgctcttatagaacttctataacaggtttggattttaagagcagtagacatttccgaaagaatttcaattgaggaaattaagtacccttagttgtattttttcaaaactcaccctctagctggtatgtgaagaagaaatgcaatacaagtctgaggagaagcaggaagacttgtggaaagaatagccacacagaggagagtccattgaaccttaaactacagttgtgataagataaagaaaaatcatttcaacccttgaagaggtgatgatctggggaggtgtagcacagaagatattcttgccagaattgaaagaaaataacttttacctcttacagagacagtagaagaaaattttaagggtagccagcaaggatgctctccatggccacaatttcaagctctatggttagtctctacccctccctgttaggatgctgagactgggaattaaaacaaagtttgatgtgaggtaactcttctagctgcagttcaggaaattgacctaatttactttattaaaattttaaattttttattttaaaattttatttttaatacatctaggcaaaggaatgttttgttccagtagacacataatctgttgcattgctccttcactccagaaactaggtaaactgtttgtaaatgttccttttaaaaattgtgttatttttatcaataccatcaagagcaagcatagcagacatgtttatttaagcaagctatgtgcttattgtgagataaaagaattgttccctgacctcaagaatcatgggaaaactcgctaaatgccaagttaaagctatacatatatatatacacacgctgtgtgtacatatacgtatatgtacacaagttgtgtgtgcatatacgtatgtacatatatacacatactgtgtatgtacacacacagacacatactgtgtaaatactcacgtaggcaaatattgtgtatatacacacgtagacacatactgtgtatatacacacgtagacacattctgtgtatataaacacgtagacacatactgtgtatgtacacacgtagacacatactgtgtatgtacacacatagacacatactgtgtatatacacatgtagacatatacacacacacacacacacacacacacatttataaaatttatgtgacaggaacctcatactattttccaaaatggctgtactaatttacattcccaccaacaatgtgtaagtgtacttttctccacagcctctccaacatttatctttcatcattttgaaagtagccgttctaattttaacatgtgtaaggtgacacatcattgtggttttcacatttttctgatgtttagagatgttgagcattttttcacatatctgttggccattggtgcctcttattgcgagaaatgtctgttcatatcccttgcccatttttaaatcaggttatttgttttcttgctgttgagttttttgaggtttctatatattttggatattaactccttaccagatatttggtttgcaaatattttctcttgatctgtgagctgcctcttcactctgttaatagtttcctttcctgtgcaggagctttttagtttgatgcaatctaatttgtctatttttgcttttgttgcccatgccatatccatttgagcattattcataacagccaagatacggaaacaacctaaatgtctattacaggacgaatggataaagaaaatgtgatatatatagtgatatatgcatagtggtagatatatatagtgatttatatatactgatatatagagatatatatactgatatatatagtgacatatatatatagtgataaatatattccagtgtctatatatgatatatatatgcaatggaatactatacagtctttaaaaggaaggaatttctgtcatttgccaccatgtagatagaactggcggacattaggctagctgaaatgagccaggcaaagaaagacaaatactgtatgatctcacttatatgagaaatccaaaaaaaagtcaaattatagaaacagaaaatagaaaggtagttaccagagactggggggaagaggaaggttgggaaagggaaggtgttgatcaaatgatagaaagtttcagttagactggaggaataaattgtagcgatctctagtactgcgtggtggacacagttaataaaaatctatgtttcaaaattggtaaaagaatagattttaatatccgcatcacaaaaaaagataagttggtgaggtgattaatatgttaattaacctgagtgaatattttacaatgcatacatagatcaaaacatcacatgataccccataaatacacataattattatttgttagttaaatatgaaatagtttaacatgatattttgaaaataggattgctaagtggatagagctgcttttagaaaaagggaaaattcagcaaaagaaaaaaactcttaaattctaataaatatttctgtagtgtggtagtttatacttacacaaagttggtcagaaaaatgagacttacctggaaaataaatcagttgtccaggaggtgaataatagagcagtatttatgaaaatgaccccaatttcagttggttcattggagttttatgacttataaaacaaattctatggtgatcttagataaaattcctataaacccatctatttcactcatgtcagaccacaccaagtgccctttgtgagaatggagcctgagcagcagcgactttcagcagagcaagttgcataagcaaaaaggcgtgaagtaattaaaaggcatattttgactggaggatagaatattgattttgataggaaattgggctaaaatgttgattgaattcccaatcacaaagatccttgtatttcaaactaaggaaacaacttatatattgacattagaaattcaagttatactcagacttccttgcacttgtaattatctgaaggaccattcctagtatgttaatcatcatatatcatgcatgggtcctgttgtatttcttgacacctttgtcagtgttcacattttagagaaatgcttacttttgtcatggtctatgttatttaataaagtttggagcctttgctgattgcattatctccttgactttagattgatcatggggaatgaggaaaaaggtgggatctggttggcatggaattaaaggctcaagttgagcattttgccgaagtaggtatatgtcattagttcagcttcttcacacatgtgcagtgcatttttttccccacaggtaataatggggaattcaaattggactcgatttcatattcacaacaggacttctaatgtttttaaatgctgtcaatattaagactactaacatatcatctctttctccccctaaatggattacatgggtgccttttccagcttctatctaagcactatccaacagaaaaataatgtgagccatatatttaattttaaatgttctagaaaccacattaacagatcaacaggtaaaagtcatttgaaaatattgtttcatcttagaattaaaattttaaaatgtggaaatagctttacattctttttgtatgaactgtccaatatctggtgtgtctttatatatacaaaacatctcaactcaaactggccacgtttcaagtgcttaacggacgggtagccagttgctaccttattggttggcacagttacgtcttccttctctctattgtacattctctgatgcttaagtgcctattttctgagtagttctatttttcaagaggagagattttttttttcagtaaagtgttatatataaccgattgctctggtatctctttatctcgatagttatgtctctcagaattttcaatatacttctctgtttactttgctttccagttaaagtggtttgcccttgacatagactcatgtgtattagaaaatgtagcatctaatttcatacttagctcttttgttatcacaaaagaatcttgctttgcctctcttggtctgtcctttgctctccttttttctctcttcttttccctttagcccctccctcttttaagagttaaagacaagcagtttttaaacaaaaggtgcagaaaacttcttttttgtattcctttactataattttagatgtcagtttgcctatactttatcacttccatccctcacatggctatattaaatgtctagatattaatggaatttttttttttacttttcaagataaacagtagtgcaggataggagcccttaatttttattttcccaataatttacagcacgtgcttccaagcttgcaatcacttatattgattttcattttgttgaatatatttcactaataaaaccaaaaagatatctgcatttttaaagtggtcctttagcagccgaatagtagaaactgtcataggaatactttctttagagaaaaaagttacatatttataagcaatatattggctaaacgttaaatcttcaggccatatttttcctgagtctgtgctgagtctaatgatgtcagtagaactctcgaggtcttttaagatggtaggttattagattggatatgtttattgtcttattgctgtcagtaaagataaacttatctgttggattattaatctctatttctacataaaaggaaaaaaagtgagtttccgtagatggagctggtctatttctgctcctatgttgggatcacaagggcagcatctacagatatctcaccagctagtaggtggggcagctcatactgtgtttgcccttgggtacattagcttctgtataagactttttctttcttcttatctgaaacagatttagaattcttcactggcattccctggcctgcatggtttaaatgagatactctataccgttgcaaatttgtcaagcatttcctgaaccttgatagcaattactgctgtcattacatagtgtcattacattccacataagaaaatcagaaaaagaaattgtgatatttatgttagtaggtgtgtatttttttttccagcttgcctcacaaactatattagatggacaagttcccaaaccaatctttggaagtttatttcttaaagctacaaaagaatttccaagagattagattttttgaaatgaccagtttcaaatgaatttaatacaaaactaggatgagggttggaatgcaaggaggaattaaaatatgcatgttttaattatagtttaccaatatgaagtgattcctgtgagattcagttgttggacagatcagaagttatacagaaaaagatcaataattcagagactgaagtgtttcagttttcattaaacagaaagaccagaaagaagttaaagaggagacatgttcaagttcaattaaaccaaattttatgaagcttatgattcatccaacataccgccatgtgtctgcccatagtcccctctccttctagatcatttgctgaaatgacatctcagacacaatcatttgcttcattgtaactaaatacctctttacttcactgctatttataaggtcccttttggattttgtttattaataatcatctagaattcaaataaatgcatatgccactcttgccactcctcttcagcatagtactagaagtcctagccagagcagtcagacaagagaaagaaataaagggcatccaaatcggtaaagaggaagtcaaactgtcagtgtttgccgactatatgatcatttaccttcaaaaccctaaggattcctccagaaagtttctagaactgataaaataattcagcaacatttccagatacaagattaatgtacaaaaatcagtagctcttctgtataccaacaacgaccaagcagagaatcaaattaagaactcaaccccttttacaatagctgcaaaaaataaaataaaataacaacaacaacaacaaaaaacttaggaatatacctaaccaaggagtcgaaagacctctccaaggaaaactaccaaacactgctgaaagaaatcatagatgacacaaacaaatgaaaacacatcccatagtcgtggatgggtacaatcagtattgtgaaaatgaccatactgccaaaggcaatctacaaattcagtgcaatccccatcaaaataacagcatcattcttcacagaattagaaaaaaaattctaaaattaatatggaaccaaaaaggagcctgcacagccaaagcaagactaagcaaaaagaacaaatctggaggcatcacactacctgatttcaaactatactataaggccatagtcaccaaaacagcatggtactggtataaatataggcacatagaccaacagaacagaatagagaacccagaaataaaccaaaatacttacacaaactgatcttcaacaaagcaaacaaaaacatacagtaaagaaaggacacccttttcatcaaatggtgctgggataattggctagccacatgtgggagactgaaattggctcctcatctctcacattatacaaaaaccaactaaagatggtttaaagacttaaacctaagacctgaaactataaaaattctagaagataacattggaaaaaactttctagacattggcttaggcaaggatttcatgaccaggaacccaaaagcaaatgtaataaaaacaaagataaatagctggtacctaatttaaattaaaaagcttttgcacagcaaaaggaacaatcagcacagcaaacaggcaacccatggagtgggataaaatcttcacaatctatacatctgacaaaggactaatatccagaatctacaacaaactcaaatcagtaagaaaaatacaatcccatcaaaaagtgggctaaggacatgaatagacagttctcaaaaggagatatacaaatggtcaacaaacttatgaaaaaatgctaacattatgaatgatcagggaaatgcaaatcaaaaccaccatgtgataccaccttactcttgcaagaatgaccataatcaaaaaaattttaaaaagtacatgtttgcgtggatgtggtgatcaggtaacacttctacactgctgatggggatttaaacaagtacagccactatggaaaagagtgtggagattccttaactaaaagtagaactaccactcgatccagcaatcccattactgggtatctacccagaggaaaaaaagtcattattcaaaaaagatacttgcacatgcatgtttatagcagcacagttcacaccagcacaatcgtggaaccaatccaaatgcccatcactgaatgagtggttaaagaaactgtggtgagtgtgtgtgtgtgtgtgtgtgtgtgtgtatgtatgtatgtatatatgatggaatactactcagtcataaaaatgaatgaattaacagcatttgcagtgacctgaatgagattggagactattattctaagtgaagtaactcaggaatggaaaaccaaacattgtatgttctcactgatatgtgggagataatctatgaggacacacaggcattagaatgatataatggactttgggaacttgtggggaaggttggggggagagagaaaagactacaaatagggtacagtgtatactgcttaggtgatgggtgcaccaaaatctcacaaatcaccactaaagaacttactcatgtaaccaaataccacctttacccccaataacttatggaaaaataaaaaataaatgcatcaggttaatagagaaacatattatttatgtaaattaaaacagattttaagtactacaaatatcttttaataagaaatcagaagtgctcagattaaatataatctcttaacatttttatgagttcccaaataaatgcaatataaacatattgaaaaaaattatccatttctaacatttcagcatccattgccaacacactctctaagattatcgcaaccatctgaatactacattaaatacatgcaaaatactttcctatattcttctcatttagtgtagaaggaattggtatattgaaatgacattcatatcccagcaattaaaataatatgatttagataatgttatttgatgtggtgatataaaccaggactttgcagtgtgatttcatgtatttagaaacattattagccattatctgtttaaatatggcttctgccacattctgggatgcatatatattagaccgttttactgtgttctctatctttttgtgtctccatgcttcattccaggtatttccttctgaatcttaagatttagtaattttctatttacccctgtcaaatttgctgttaaacccatgcacttaattcttatttttcacttactgtatttttaattctagaatttcttttggattatccctaaaatatgttatgtcctttttatggtttacagttctctgcagcgttctcaatcttgtgtctaatctctttcaatatagtccatgtggctgcttaagtcacatttcatatatatacatatacacatacatactttaaaacgtataaacttgtttgtatatacatactgtatatctctatataatactttccctaatataattatacatataaaagtatatacatacacatatgcctctttaatagcctgttttctcaattgcaattgggattaacaatgtatatgtctcacaggtttattataagaattaagaatgataatatttatggggttattactagagttcttgatacatatactaagcatgcgtacatgggtgttctttcagtaaaattagacatgacatgatataatttaaaaatcaaggtcttcggataatgatactattttttttccaaggcaaatgataacactgagagagagtagcctttcagtatcagatacaattggaccctgctcggtttctgcaaataccatctgtatcaccttgggcaatttacttagcttctctgtttttctgtttcctgcccttatctgtttttctgtttcctgaccttataaaacgaattgaacaatatagattttacaggctgatttgtgaatttaatgtaatatgtgtaaggtccctggcatattacacatgtagcaggaatgtatcttcataatcatattaaatatatttttcagattttctaattttgttaatatttgaaactagtaatataattgagtttgctgacaatttaggaaaacatggcaaagtgtgaaacaattaagtgattctcattcttttttcccttttgataaagtttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggtctgtgaatatttgaatgtcaaaacaataaagcacgcttatcaagcattcacattgatataacctttaaataatattagaatttaagtcattctgacaagtatggtagtttgcccattgagcaaatgaaaatgagactttacagtattatttatgcatatactctatctatggatatatatgtatgggcatatatacatgctgtttttgaaaacaattgtatgatctatttatgaagtatatttttaatttagcatgcattttcagatgtattgattttgattattagaaaaaccattgttttattccccacctttgcttctttatttgtaactcctgtcacattctcaaactggtgggtaaaatcagtgtacagtcatcccttcgtatccatggggaagtggttccaggaactcctatgaatatcagaattcacagatgttcaagtcctttatatgaatggtgtaatatttgcatataacttatgaacatgctcccatatactttaactcatctctggattacttataatgcctaatacaatgtaaatattatgaaaatatgtgttatactgtattatttaggaagtagtgacaatgaaaaagtcttacatgtttagtacagatgtagttatttttgtcaaatattatctattagtagttgactgaatccactcattcagaatccacaaatatggagggctggctatatttataaaattggtttaaatttaaacattaattttctgtaatgtaatgagacatttgaattctaatagctacatttttttaacatccttctatcaggaaagatatactaatatgggaaatgaaagaaataatttgtaagagattttataatacttttcctactttattttatttttagacggagtttcattcttgttgcccaggctggagtgcagcagtgctatctcggctcactgcaacctacgcctcccgggttcaagtgattctcctgccttagcctcctgagtagctgggattatagtgcgtgccatcacgcctggctaatttttgtatttttaaagtaaagatggggtttcaccatcttggccatgctggtctcaaactcctgacctcagatgatctgcctgcctcagcctcccaaagtgctgggattacaggtgtgagccactgcgcccagcccttttcctacttattataaaatactacattatatgttcaataactttttatttctgaagacatgaaaacgtattagttatatttagaagctgagataatatgtgcattttaagaaaaatgtttaaaaattcaaatttaaactttatcacatagaattttttttggataattaaatatttttttgaagtaatgtattcaaagaaaaatacatttaaacaactttcattatgtattgtcctatttagatatttattctactacaataccaaatggtagctgtttcaccttttttgtttccttttgttgtggtttttaatgcttggcataatgattccaaagtctatctggaaaaatgtgttgcctaatagaactagtaaacttttaaacataagaataaaaatgtgcaagaataagagtggagaaaacacaagaaaaggcagttagatgagcagaagagactatttccactgaaaaagataggaaagaaaataattgttcataaatattattgggaaatgtattaactaactaaaaaaaaagatatgaacatttcccccaaagttacaccaaaataaaaaccacatacaataaaatgttcaaaaaatgtggggaagcccaaattttggaaaatatttaaaataataatgttataaaaatttaggtggagaagcataaaaatcgatggaaacaatcacaaacattgtaaaaacaccagagacaattttaaagaaatatgataccaaggaatctttttttttctgtgagtaaggaagaaagtcttgagtaaggtatcctccaaaaagagacatatatgaataataaacctatgaataattgtaacttaaattgtaaaggaagaagtaaaaaaattacaagatgagaattttttttgcatactaaattgcatacacacaaaagatataagtaccaatttgcaagtggtgaaataaaaattgtctcttactgctggaaatgtaaattcaatatgaattttactgaggttaactcttcagtgcatcctaataacatacaacattaatataatttccatgaaatctgtatctgatggaaataatcagaatacactcaaagatgtaaatggaactggagatagataggatattgattgattgagggatggatggatggattagataggtaggtagatagagataaacataatttacaggagtggaaaactagaaatgaatgtgtagaactaataatggaaattgttgaactagaaaagccattacaatttttgtttttgaaaaaataattatttgacatgggcaaatgctcacactaaaacacctagctcaaagtgtagttatatgctagatattgtctaaataatcagtcataggggaacaatttgaaaaagtgaaataaacttaaaaaagtaaagtaaaaaaacaaattaagtaccaccaaataggcataggatactatgaaactataaaacttagatatttgacaaattttgggttgatataggtcacattataggggaaagaataactgtttatatgtgcatacatgatcatatatttaatatttagctatacatagaacaaattgaaaatttatataaagtactagtagttctggtttttttttccatttttgtcatgagcctttattattttataaagtaaaagtaacattaaagtaaatattgaacaggggaagtctaaagttatgatcctactgtaagaaattacatgtgttatacagaataagtataaataaattttataaattctccacaaaactatccttgaatcccaccataatactacataacagaataacattttttgaaaatatattaagtacatagattgttcaataagtttttctattccatatatcaatattattagctatagttttatgtagagtttactttcctgaaagctcagtataattaatttcaactccattaactgtatcacaaatgcagttattaatatatatacttaattcagtaaaattagatgcaccaaaactttttggctctgtaagatatagttttgagatatatttgacattgttcagaaaaatacatatggagtgttaaataccactaaataatattcaagttactcttaggataatatgtaaaatttaaattaccactagaagtttataactgatagaagatcatctactttgtttacatgtttgaatcatatagatttcaagtacagttaatttcactaaaactcatcaattattattcatcaattagggtaaatgtatttaaaaaattgttttttaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcaggtaattcaagattttactttctaccctcatttttatttacttgttttttccctaacgatacactgtaaactgtaaaggtacataagcatttgaccttcagcatctttcaaagttagtgagaagatgaaaagacatgagtcttttacaaaggatggcgatttgcttattccttctaggaaaagaataggagttttctcagtgtttttagaatgaattttctattttcaccattaccaataggaattaaacatgtttttagtttaataattttcaaaaccaatcatccatttagtctggttgtcttttaagatacgggtaatcatttagcttatgactagaaaaaagttatgtatatatacattatacagaggtatattgtaatcattttatatatataatgtatagtatgtatatgattatttcctatattacctttcatttctgctgttttgctacttataaaaagtaggagtcaactatgctgtctatatgtgctattatatataaaatatggtgatatgttcataaaattgcattatatattcatcccattatgtataactccatatatgtatatgtgcagtagaaatgtaggtgtattaatgtcctatgatactcctaagaaattagcagaaatttaatggcttcaaacaacacaaatttattacattactgttctggaggtcagaagttcagaattaatctctgtgggctaaaattaaggtgttagcagaactgtgtctgttttggagactttgaaagagaatgtgtgttattggcatttttagcttccatatatatatgtatatatatacacacacatacatataacatgtatatatgtgtgtatatatatatatatatacgtgtataatggaattatatatcatgtacatatatacatatctaatgtaatatatatcacatatgtaacctgttgtatatgtatattaatgttacatatgtaatatatagtaataacttattttatcaccatatcgaatttgtaattatatgcttaaattttaccacatcaccttcttcctgaaaccaaattcccttgacttaatttgtttgaatagtgccaccatactaataaccactcaagctaaagaaaaacagtaaaccaacaattgcattaaggtctaaaagcctaaaatattcaataaggtaagtaatgtgtcccttgagtggtcaattattgtgacaaatgttaatgctgggaaggaaatgtcgaaaacgttatggtatgatggaaaaacattgcaacaatatgctcctggatttaaatcccagtctagctgcttagtttttgtgcttaccttttacaaaccaaagcactaagcaaacctaaaacattttttaatgcatagcatttctttacttataaacatatgtgtacatgcatacctatgtaaatactgcatgaaaatatctattatttgtcaagaccagtggcctaagagggcacaattacatggctcttgttatcaaggagcccacattctagtgaaggaggaaggtaggtgtattcatttcctatggcactcctaacaaattgccggaaatttaataacttcaagcaacacaaatttattagagttctggaagtcaaaagttcaggattagtctcagtgggctaaaattaaggtgtcagcaggactttgtctgttttggaggctttgcgacagagtctgttttattggcatttttagcttctagaagcattccttgtctcatgtccccatcctccatcttcaaagtcagcagtgtaacatcatctagtgtcaatttctctctccctgtctatctccctctccctctctttctacctctccttctcaccttcctttccctatcctgttccctgtgttgacttccttttaattaggacctttgtgattacattatgccctggtggatgatccagtataatctccccatctcagaatccttaatgtaatcacatctgcaaagtcctttctggtaatatactcacaggtttcagagattagggtgaggacatcttgggggtagcattattcagccttgcatggtaaataaattaaacagtatgggaaaggttgtcacagtaggcaggaaggaaatccaacataaactaggaaaaaggattatgaaatattatcggaacataggttgtctctgctatagattaaataggtagaatttagttagctaataccgagaaagaaagagttcttgagaaagcatagcagcattttcagttaaatgatataagttcaacactgggtagacaatatatatggggattaataaaatattatggttggaaaactggattgagagtagacagtgaatgtccttggatgctatgttttacaatctgagttttaatctagtggtgatgggactgataataataacaataaaaacttaataagaaaaaactgctattggttaaagagggaaataatatgattccacttgtgttttcaaaacattcccaagatgagaggaaggaggagaggagattactggcatcactgtagatcagtaattagaatgaggtgagaccgaggcagatatcaaaacgagccagtgcattaatggagtcactaatgagacctgaacagcccaggcgtagtggctcatgcctataatcccagcactctgggcagctgaggcaggtagatcacgaggtcaagagatcaagaccatgctggccaacatggcgaaaccctgtctctactaaaaacacaaaaattagctgggcatggtagtgcacgcctgtaatcccagctacttgggaggctgaggcaggagaatggcgtgaacctgggaggtggaggctgcagtgagccaagattgtgccacttcactccagcctgggcgacagagcaagactccatctcaaaaaaaaaaaaaaaaaaaaacaaaaaacaaacaaaaaaaaaaagacctgaacaaggacagtgaagatgtgaaataagaacaaatgtagacttgaaagataacagcaaggtgatcgtcttgaagttctcttagataaatagtttaaaaattattattaataatcacattaaaggggaaactttctgtggagcacatattttcaatgtaaatttaagtaaaacagaagaaaataacacatgtagacagcatagttgaatcatactttttagaagtggcaaaacagcagaaaaaaaggtaatacgggaaagaatcatgggtgagagatactggctatttataaatgataaaagatgatgatttttacctgatcattacttcgtactggtcagacaaataaaagcaaaagctctgtctttgaagatgacaaaatattagtccaaaagttcccaactggaaggactatttaaactgtcatctgtagaaaataatttgtgaaagttcgggtttagggaggctataaagacaccattacattgagtttattgttcatagtttgttttatgtactgtaaggacacatttttagtattctcatgagttgttttgtaacttaaaatttctctagagggggatatgatttaatgttctcgagagtaacatcataaaaccacatttggtagtaattttgtatttttaacaatagcagacttcacacaccagtgctcatacagtagaccataaaaatgcagtcttagtaaaaatattctttgcctcaagaactacttagagacatcctttaaacatgggaattgtttttgggcctgtgtttagacataacacaatgatgaattgtgttaaaagtaatcagcacaccagtaatgccttataacgggtctcgtttcagaatcacatacaaaccctgaagaaatggatggctgaagttgatgtttttctgaaggaggaatggcctgcccttggggattcagaaattctaaaaaagcagctgaaacagtgcagagtaagatttttatatgatgcctttaatatgaataattttgtatgaatattatttggttagatcagtgttttacagctggggtggattttgctctcctctccccagtggattttttttaatgtttctagacgtttttgattgtcacagctgggttgggggtggtggttagatgctactggtgtctaataggtagaggagagagatgctgctaaatatcgtacagtccatagaacattcctccagaacaaggaactgcacaatctaaaatgtcactagtgccaatgttgagaaaccctgggttgagtaaatgaggaactgacaaaacattgccttgtactcaacctcatttgataacattattttactataaaatgcagtataatttaaaggtaaagaatcctttgagctacttgttatttcttatgataaattactattcatactgtgttgttctcttcatctataatgcactgtactataatataacacagtatgcattttgaaataatattcattataccattgtcatgcagcaggaagaaaacaatcttgctctttaaggaaatttttttacaatacaagctaaaaaagcaaatccacctcacaaataaccttcacacccattacactgtaaacaatttctgcagtatcctgtgtttgaaaatgaaaatactaacaaagataataaagtatgaagcccatcattttcacacatttttctaaccagaaatattaaatttatttccttttgtttctgatataagtagaatacaaataattccccactggattcatgccataataaccattgaacatttttgcaagactgttaggcagtcatctatatcaatatctctgtatctcagattttaaaagacaaaaatccatatgcaatgccatcagtcccaattttacattttctagctatgtttcatatctaatatgtggcagtaatttttttcagctggcttaaattgatttattttcttagcttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtatagacaatctctttcactgtggcttgcctcaacgtacttaactaagatttcctaatgtctcccttcaccgttacttttggttaaggctttgttcctatgtttttgctttaaagcacaattaattctgacaaattaatcttttttctagcatatctaaatattttcatggtatatattttaaatagtacacattcatcttattttgatcctaaaatgactttcttgaacacaactgtcatactaaaaaatgaaatcctattcttagtcattatttccaatccatgttttcttcagaacataaatgtataataataatgggattaagaaaaatttgttacacggagatatttggtacaaaataaaatgcatggctaatatatgtgtatgtagaaataggataaataattataactttcgattaacatttccaagtttggcctcttcgacacatttattatttatttattttattttttgggacagggtctccctctgtcacccaggctggagtgcagtggtgtgaactcggctcactgcagcctcaacctcctgggctcaagcaattctcccatctcagtccccacaagtagctagaagtacaggtgtgtgccaccatgcctggctaattttttgttattttttggtagagacagggtcttgctgtgtttcccaggctggttttgaattcctgggctcaaacaatgctctttccttggcctcccaaaatgctggaattataggtgtgagttaccacacctggctgacatctagttttaaataacaattaagattcagtaaccattaagaatagctgaatttcaaaaaaaaacacacacaaaatgactgtacactcatatttgagtttctcatttttctacagaagaatattttatagatatctctcttatatttaaatattcaattacggatagtaagatatattcaaaaatagtgtatatcaaatacttcttgttcgaaagataaaattttgaactaaagcaatgaatacttttaagttcaccaatacattagtccccgatcatctgcagttttgctttccctggtttcaaatgcttgtggtcaattggaatcctaaaatcggtgagcacagtaaaataagatattttgagagggagaagaagagagataacttgttctattttattagttgttaatctcttactatgcctaatttataaattaaattttataggtatgtatgagtaggaaaaaatctagtgtatatagggttaggtatcatctatggtttcaggcatctattggaggtcttggtatgaacatatcttccaaagatacaagggaactactgtacctttttggaaattaataaggggtttcaatttacgtgttagaggcagttggtctttggttactgctaagtaaactttcaaaatagaaaagaagtaatgtcaaaaggcaaaagctacatttgaaaatgaaaaaaaaaattagaaaagtcaagggaaatcactcagctaatacaatcactgacaagtgttcattggttctgttaattcacagatgagctgtccctgggtcagctagctcacattcttctcctgaagtaagtcagtgctagaagagttgtttaggaaaaaaaaaaaatattacttaaataatagattataccattgatgttttcctggaaggccagtgtgaaaggtatttgttttttgtttgttgaatgttcttaatggatgaataaaaagaacatcaccaatttatgtagagcaaggggaaaacatcagccaaaaaaaaaaagtataaaaccaacaatattactaaaacctcaaggtttttacattttacaggagtacaatttgtaaaggctctctaaaaatgtctttgcttaagaccttatgtctgttatatgtactaagaatttgttgttcaagagatatattttaaacacactcatctgttgcatagcaaaaaagctatagatccaagctatgttctgatctccattttctaatcttagaatattatatgtatctgtgcttttcctacaagtatcactctggccatgttctgactttgtagccaaatgagttaggttgtaaaaggaaggaacaatggcgctcaaggagaagaagaagacgatgcggtaaaaacaaggaagccatatgtgaatattgttaccaattcagcattccagagagaataatggaaatgaagtgtaaatctatgcattacagaaatatctacagacaaaataagtgtgtgatacactcttttgggttaaagataattccttttttgtcaccagatgccaatgtctgcgaaaacataaataatttgaaacaaaattgtccaaatatctgatacatttgaagatgctttcacatcccatgatctaattttgggtatataaaatggttattattttaaattttaaagggtatgtatataagtttaaaaatctagattctagctatttctaaaaaaatgatcagatataagtgagggaataaaatagacattgtagttaccttcacggagataatagtttagtggtgaaaatggaaagtaaataggttaacacattatcacaacaatgtcttgtttgaagtcttgcttacactctgaatgtagcaataagaaccctttaaatgagagtgacaggagcaggaaaactactttctattgggtagtcagtagagtgttttctgaagaggcgaaattaaagctgatacccgagtagtaggaacttgacaatttgttgtgtcaaggaattctgccagaaaatgaagtggagaaaacatctgaggcaagagagggcttagcatgtttgaggagctcaaaggaagccaggagaaaaagagtgggaaaatgagtcagaaaggaatatggaagccacagtgatgatttagtcattatgtcaagtactttggaaagtcatctgacttttaagcataggagtggcatcatttcatttcatttaaaatggttgttttaagtttgctgcatattcctattagaagaagaataaatcaaaagggctgaagtggaagcaggtagggattgcaattgtccaggtagaaaaaaaaaacaggcaggaaaaaggggatatttgtggatattgtagttttctgaggaacctccatgctgttctctacagtgactgtaccatttatattcccactaacagtgtagtgtagttcctttttatctgcatccgtgccaacaattattttttgtctttttggcaatatacatcctagctggggtgaggtgatacctcattgtggttttggtttgcatttatttgatgattaccgatgtggaatttttttttcatatattaattggccatttttttcttcttttggaaataactgttcagattatttgcccatttttgaatcccatcacatccacatatgatatgatgttttatatcataaaatcgttatttttctttttatgatatctgagtttctagcttctgcacagcaaaggaaacagtaaacagaatgaaaagacaatccacagaatgggaaaaaatatttgcaaactactcatccaacagaggattagtatcctcattacatttttgatgaggactttcacacttacatctacccagaagtattattcctatcctaacatgacacattcctttattctttttaacagatcccattagatctggcagtacttgctgaaggagagtgtttgttgatagtctagaggaagaatgagggaagaatcaaagtgttttcagatatatttctgttatgagctacattgtaggtcattgtgattttaaagaaagagtgggtactaagagaagaacaaaatggaatagcttactagagtgactagcggttccatcttagccatatttatttcggagaaaaagacaatcagacatgtatctggaagtcaagtacacttttcaaactgggcatataaacgaggtacataaaaataaagataacatgtatataagatactgtttcttgcctattgagaagatttccccatgctcccatccctaaaatgcttggtcaaattggataattcgtaaactcttagagatggaagagaatctatttttgtttaaaccactttgttgaggtatgactgacataccaaaagctgtacatatttaatttatacaacttgattagtttggggataagcgtatacccatgagacttattaccacattcaagatgataaacttacctatcacctccaaaagtttccttctgccccttaatttatttattttttttgttttgtgataagagctcctaagatctatcctcttggaatatttttaacaatacagtatttttaactataggcccaatgttgtacagtagatctgcagagctaattcatcttgcataactgaagctttgtatcctttgggcatcattttgccattttcccctctctcagcctttggaaaccactattctactctctagttctgtgagtttgactattttagattctagggaatggaaggaaatattcacaaatcatatgtctggcaaatgattaatatccaaaatatataaggaacttctaaaattcaatagcaaaaataaaactgaaaaataacctgattaaaaatgagcacaggacttgaatagtcatttctctaaagaatacgtagaaatgaccaacaggtatatgaaaaggtgcatcactaatcatctgaaaaatgcagttaaaagccacaagaacctcttcatacctgttagggtggctattatcagaacaaaacaaagcaaaagatactaagtgttggcaagaatgtggagaaaagggaattcttttatggtgttggttggaatgtaaattggtgcagccatttgggagaacagtttggaggttcctcaaaaaattacaaatagaattcccatttgattcaccaatcccgcttctggatatatatccaaaggaaataaaatcaggatctcaaggaggtatctgcacccctatgtttacagcagcaatatttacaatagccaagacatggaaacaatctaaatgtatattgtcaaataaataaaacatggtatatgcatataacggaatattatgtagctttaaaaaagaaaattcttccatttgcagcagcatagatgaacttggaggatagtatgctaagtgaaataaaccagacacacgcggtcaaatactggagaatattttttttgtggatggaaaggcacagtgtgtaagaccagaagctctgagatcagatcgcctgggtttaagtctatccacatcataaactgcctgtgtgattctagaaaagttgtttaacctttttgtgcttgagtctcccaatctttaaaatgtgatgatattaatacataattcataagtatataataattaaatgaattcatcttttcaaggtgtatagagcctcatctaacctagattaatcactgtacatgtttgttagatagaaaacaaatagaaacctacatatatagaattataaaacatgtatactttctaagtaaataatatatggttatatattttaattattagtggctttaaatttatagtaaatagttatcaataaatgggatttagaggttacgtggatgtctttctgccagcttgcagatcattgtctttctctgggtcagtatactctttgggtgtagtgatccccagatctctttcgtcagatctctaacagtctgtttttccatctttctgcaaaaaactagcttcttgttttaccgagaaaatataagcaatcagaatagaagttgcagtactcccactgacctgcatataagctcacagactctactttccctttgtttacatagatgaactttctgtgcttttgtctaaggccagcttttccacttacgtacctggatccctttcccttgtctctgcacaaggacattgtaacagctaatgaacagccctctacctcctacatcttctccacgctacatcattcccatcattcccatcagtagagaattattctgtaatatctcctgtcatttaaaagaatcctcaattggacaacaatctctctagcaacctctccattcccgtttccctttacagacattcctttctctccatttcactccttcccttctctcttgatgccaattaagagagctaatcaaactgttatcctcactattctattaaagcagattttgtcagggtcatcagtgaattcgtattactaaatcgctaaattcagttggcttctgtgtcatcattctttcttaattatctcttagttttccctgaccactgtcaatatccttggtggttctattgccctgaccactaaatttgaaagtgttccagggctcagtctgtggactccttttttttttccccctattaccacccactctccgggtcaacttatcaagctccatagttttaaatgtaatctgtaagttgttcctgctgtaagttttttttttttttttttttaacaatctggaccctttctaatgatcctagacctgcatacccatttgcccactcaacacctccacatcaattaataataggcatattaaatctaacatgttaaaacaaaattcctgatgtataccccagtctactaccctagaaatttgcctgttattacaaatggcacctccatctttccacttattcaagccaaatcccacgagattttcttgtctcctatatttctcttacagccgaacatcaaatctatcaccaaatgctgtcgtttttgccttcaaaatttccaggatccaacaatatctcaccatacttgagcacgtgcacacacacacacacatacacacacacacacacacacacacacacacacacacacaaagtatgtatgtgaatgtatagtttttactagaagtcttggctgaattccattagtccctctaatatttttgtagcttcaccaactgccttaaaagattataacagagcagagtttctaagtagaaatttagcagcaggatttcttaatttataaaatagcaaaaatagcagcatgttttcttaagtttattataggttcattgactgcacaaaataacatttataccttttctagtacaattgcaagacatattgttctagatgtgttagggtgaaacatttatttacattgtagtagatcaagtactacatttacctaggtaagtaaagaacctaaaatgaagtattatctatattaggctcaaaatggttgtaaattataaggaaaatcaatgcgatagtgattctacacatatttactattgggcaaagtaccatgaacacttcattttactaaaactgtgcattatatattaatactatgaaaactctgttacttaaaatgtataatgttgtttcaaccagagagaagaataccatcttttgaatagagttactttttaaagtaaaagcactatgtataatgattgtaatactatagagtgccttgtaacaaggtgtatgattttcttttagatgttttaagttttgcatttttctggttaatgagtaatggagtccattgtagaaagttttagttttcaaaaatgcgtgaggctttaaatagcagatgttttctataaccacagacagactcttttgcaacttgcattttacacgtaaaactttatattgagccacttttcatttcagtaaagatgtatttgtgatgcacagtatcccatagtatatatatgtcataatttaatctctcatgaaagcacctttgggtttgttttcaagatgtttggtctttaaagctgaattaaatattgtacatgttagtctctacactttggttggcatgattcactctcaaaaaatggagcagttgactcagattcgtggacattaacatttttatatgttttgccatcttactatctaaaaggttgtattatgttggatatttccctcaacaagtataaaaactttgattttcccacatccctgcccaaaatgggctctttattaattattatttttccctgtcttaacatgtgaaaatgcattaattcacttcgatttgcaatcatttaactataaatggtattagaacatcttttatatacatgtattgccatatattatcttctttgtgaattgccaaactacgttttatgcacttttcgttttttctttttaatttatgagagtttctgtagatacatgattatgaagttcttagaatatttaaaatagtaaaacattatgaaagaacacaaagaataactatttctatgtatgccaataaaattacttttccaactgaaacatattattttaaaaagccttgtttttctccattcacagaaaagcattgtcacacaaacagctgaattatcatcatcgggcaatacgttcattttattaagtatgccaaataaacagacatgtcttattttcacacttatgggaaattgagtgtatctgatccccatgagttattttcttatgcatataagctttttacttctttatcattactatctaagctttctgttatttacatactgatgaaataatataataataatgtttcatcactgtcaataatcgtgttttgtttgtttgttttgtggaaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaaggtaaaaaaaaaaaaagaaaaactaagtaaaacaaaggaaataaatggaaaaagaaagaaatgcaacaatgcttgaagttgtatacagtctgctctttcctggttctaagagaagaggttgatttttaattaataattttaatttagcttcaagtttaatatacattttaacaaccttaaactgtttaattttaatgcattgtggtcaattatgaaaattgaaaatcacaatttgaaacaattttcccttgaaatcatgtagtattaagagagcagaatcaactcatttcattaactgtctgtagctgatgtaaatgtacgttgaaactgtgcaaaagtattcttgaaaagacaaatttataatgtagtcaacaaactgtgttaatttggtagtttgaaggcatttctgagaatttggaaacactaaatatttgaacccgtagcctttaatatggatagaaaggactgagtttacatgtacttttcttgaaacaataggacaaaatataacattgacttattacgaaggaaactggtatgtagtatgtagtatggatttggaggtgaagcctggacttgaacctacatagtggcatttcgtatggccttgggcaacaatataatagtcaatataatcctctgttttatcatgtttatatcatcatacttcctcacttgaatgtatgaactgttgattgtaactaccatgtgagtaaattgcctaactcagagttggtgctcaattagtagctataatcataattattatttttatgtgctagcaagaacttagagaatgacttgaaatattaatactgtagatctttttttggttcaaggattgtgacaaggaaaaatcaatgtggagccagatacttgagtttaaaacttagttcggccccatgccaactgtataaattggggtgagttacatgagcttactgagccaaattccttcgtttgtgaactgggtatcagaatgtctgctttcagaatcattagagggatgaaatatgaaatttctaacacaatgcctagcacagtataaatgaccatgactcattatttattattttaattgtgaaagggccacatggtaaaaaattatataattaaatggtaattcagaaatatctattatagttaatagcagaaagtaactcacatgaaaactcagatgtttaaatatcgaatctgtcatacggctttagtcaaatgttgaaagtaaatatctaatatactccataaatatgtataaatattatgtgtgtataaaactataatgaagaaaaaattagtataatcatttctagagtattaaaaacacagaattattctaatctagcaatagcatatttatcaactaaaacttattgcatacttactgtgtgccaaacaccctctggctactgaatatagagggtggtgagcaagaccactgccttggaatttacattctagtgttctagcgtgtggtgaggagcaggcaataaatggaaaaataaatgaaatcatgataatttgcctagaagtaaacatggattttgaaatcaagaatgaataatgttcaggcaggatttgagggtggtaggatgctattttagaaaaacttgacttatagagcatttatgaagaattgtatgtaatatgagagaactgaatcataaggaaaagccaaccacttaaaaaaatctttatggaaacacattctattcagagagcatagcttctgcaaagaccctgaagctaattgggaagagaaagaaatctgcctgaaggaaggaaaatgggataaaattacctcagataagtcttaggaggtgggcaaatatctgttaacaaacgggttttgttagagtatcacagtttttattctaaatggacaagaaaaaccattggagtatttcaaaagaccaaaataatttaaaatttgactttggggaggtcacccctgaggaaaactttatcagaatgtgagagctagaaggtactttgaaacttgtgtaattcacacttctctctctgcttatcagaaaactgcaattcccagataggtcaaatgatttagccatagtcacagactttatttgtggtagagcccacaggattgaaggtattttattctatttcatctcttttttcctttcctttcctttcctttcctttcctttcctttcctttcctttcctttcctttcctttcctttcctttcctttcctttccctttccctttccctttccctttccctttccctttcctttcccttccctttccctttccctttccctttccctttccctttccctttccctttccctttccctttcactttcactttcactttcactttcactttccctttccttttcctttcctttcttttccattgtgtgtcactcatatggccttttctcttgtatctcaattcctttctcactgcgtctatttatatatggccactacctcagatccgtaagtagatactatagagtcatttgtgttcagctgctctgattatccctgggttcctttggttcagtgcctcttctggccctcttccctctccctatgagcgatttgcctatgtcaccaacaacccagtcagatctctcttattttcctgtgctctagagtaaactgtctcaaatttttaaaatttgaaaaccatccttgaaatgagtgttccaacaaatttgtctacattgattgacatgttttgataattggtctagctacaaaattggtttagtatgggggtgatagtaaaaagaggtaaactctggaagcctctggcaacaaccactggaagagttggcaggaagatttcatttcttgagttttcagcctgctactcaagacagtttctttaaggcaacttcactacctggaggttagcaatagtaccttgtccagacttctacctgtgctcatttgatagctaatttttctttattgtcagaagatactaacagacctattttgacatctctccctgatactcaaagaagaaatagagacccccccttctgtttatgttctttcctgtgttttacctgaaaatggaagtgctgttttaataacttatttttcccctgaaaaggaaagtttttttgacataaaagaacccagggtacagtttgataaacaacctctgactttaaaacttttatggagatcagcaatcactatatggtaaaactttatactaaaaccctttgaaaaacactctggaaagttattaactggttttatttttttttaatttttactctattataactctagtactagtgcttaccagaacttacacataaagtgagaatagtaaatacacaaataaatttgtataatcactacagcagtgattcctgcatctgaatggacatcagaatcacctggaagtcttgtttaatacacagagtgctgggccctgaccccagaatttctgattcagtgagtcttgggtgaggcctgtagtttttcatttttaacaagtttgagtttgataccaaagaacaagttgcagagtgattccaagggtgctcactttaagaagcacgggtgtgaaatcctagcaatgaaagatggcagagcatatcatagttagattcatggaaagaaacaagagccaccgtttttatgaggatttgtatagaaactgtaccagtcatttagctttctaccttttctcctagtagagaaattcatcatcatcttctttcctcatatgtacctggattaataaattttgctgtttgttcttcgaacctttcccaagatctgagcctcttattaaaccaagaatatatgaagtctaaaaaccatggaaagaagtgttcttcattctacatttttatatagttgcttgggttatttataatgagcataaattgtaattttattcattagactgactacagcatgctccttcttcagctcatggaacatttgagacccgcttaacagaaactatgagaaagagaggatataactctgaggatgatttccttaaactctctgaacctcagttttctaatgtccaatatagaggtaacaaaacacatccgagaaggtttgggtaaagatctaatgaggtagcacttatgacatggctggcacagaacacagtagcacatattaaatgatgaatggtaatcaaacttgttgattatactataattactaaagtcaaaatgcaatttgtgtaaaaacaatctctatgctcagtgatgccaaaaagctgatttatttagaatattgaactaaagatttcaatcaattaaaatcggtgaagttaagcattctatagacaaaacaatttgcattttctgacataatgcatacttttaaggaattgtgggactaaatccaaaggagtagggtgattatgctgacacatacaaaggcattttatagctgaccttatccatatcctgccaataagcccttaccttaaccaccgcattgtatgcaggcccaacttctacattatagaacctgagttcctttacttgagggctttctgtggccactgaatcccacttttgcacttgtgtggtaggcttgcaagtactgggaaattaacatttccccaacagcctttaacaattagggaagatgatacagaaataataccccaatttcttcacccctgaatgggataacccgcaggcatatatttctcagggctttctaacaggattaaactctagtcattaacagtgtttgctgggattaataagtatgcccatatggatgtctcttccctttcttgtctcaattccccattcagctaccagaatttcttttacatggcacacataaataaactacttatatttgaaagctaatgtcaggtttgacccctggaggaacacagactaaagatacagtgtgtatgtgtgtgtgtttctaaaatacatgtacgcatttgaagttaaggagtgtaaatgtctcccaaccgaagaccaccaccaactctcttgtagctgaacaagttgggttcattattttttgcaatgagggagaatacacaacatggaggccagggggtgcgtgtggatgaaaaaaaaaaaaaacattgtaggatttgtgcttgtgttaggggatttgagggagggtttaaaagctttactttggattgcttgtcattagtgtgtagggatagctatatgggtatcgtatcttgtccagaaggagagaagaccagaatgaggctaaagttgcaattaataaagaaacggcgttcgttcatattaaccaggataggagagtgttgggcgttttgtggtttgggtaatgttgatgtttttgtctggattcagacatgattatggaatgatcttgtcatggtcttgatccattatggaaacaaagtggccttttccaatgttgaaattctgtgaaacagtttattttccacttgagaagaccaaggcatagctgggtgtcaggccagcttctgatatcagcagctccttttttggtttctctttctctcatgtgttttcaattctcgaacgaaactttcttttatcaaaatatgttcctaaatatagcatcaaggggacctttctatgttaagtatcctttaacttaaataatgatatttgtgatggtttcaatattattcatccaagtaatttataagtgatttcaattctagactgccaaatattttttaacctagttaatattgaaatatttgtttcttgccttttccaaacaattgtatttatatcaatgtgtatatatttgaccacaaatccatacctccatgcagactacttttcagtctattcttgttacagatctgttgtattcttataataaattatttctttaactttccaatttcaactaaacttaaatttatggaagagactggagttcatattagatttatttttgtaattctcattctaactgggatgttgtgagaaagaaattatatgattcatagaaatgcattttggatgtaaagttattttcatgctattaagagagcattctttatttttcagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagtcagttgcttttcttggtctttgtcaatgatatgtcaatacatggtcatatgtgaggcatagtggttaagaacatggataccagtgcaaaacaactttggcttgaattcctcattcaggcacttataagttgtatgactttgggccatttgcttaacttgtgtaaacctgttttcaatctgtcaactagacataatacataattcataagttgttgagaaaattaaatgagctattctctttaaactacttagcctagtactcaatatatgtgagtagctatgcttctaattctcattactattattaggtcataaaatcctataaattttctccagatttatagacaatgatctttattttttcttatttttgtatgtacataaacttatttaagtatctttggggaaaagcattctgtagagaagtatgtttttactacaattgtctttagtaattgccgtgccccatagagttctttgttagacatgttacctaaccagctctatattttttgatggtttgcattatatttatgtattatcacaacttctgctttaacttttatggatgggccttactgtctagattatgcttatctgaatttagataaagaaagcaggtgcctcaaatgatggccatgtaattgcatcaaaaataagctatgacctttcttatgaaaatactgtgccaaggggcacaaaactttatccactacaaatgctgatgctgccagacattgcacatgagttggactttaagcccccttccctcacacagactgagttattttggtgaatatggttaataaagtgttcaggtacctctttacttttgaaaaacattatttagtttgcttcctatgttgagggtttgatatttaaagaaagatacgattcagatcaataataaagtacacctttaaaaatattttaaaatgtatttgtagctaaagtaccccatatattcccaatacagtattatcattttccaattgtaaaatgtgatccgagtttctccattatcagttctaagctcttctttactcatccttattcttttcttttaaatgcaattcactcctcagactcttgaaaagtgccttctatatgtcaggaaatattacagtttctgaggatataatgacgtatcttatgtatcagtgttatgtgagtgctatataaaatataacaaagaatgggaagggaagggatctgatggcactgtacatgtctcaagaaaaccacaattaattcactaacatgttacaatagggagggactttttgtacccaggaaatgctttctgacaatgtttaaataaaacacctactattactttcttatgttcttaatgtccttaaataagcatcattgttccctattattcatgttgttcatttaaatgatactccgtgattcattagaaatttatattggagtacattttccgaagggattttcttaagttttcgtattaataacaaacttttcaagaccaattattggattatttttccatttccttctcatgtataataacatttctaacattccctattcatattgaagttatcaaattattgagttccattttagtcctttttcactggtttggaatatgtactttattttatcttataaatatttctctatacctctctaacaataatatggtggaaacattagcatagtttaactctgaacctacctcttccgttttccgcgttattgttgcctcatatttcattttcaccttatttcccccaaattagtccatataattgctgttgctgctgctgttgttttaactatttcatataatatttatttagatttaccgatgctattttcccagtttttgtgatcagttttgccttttgttcttccctttgcttctgtgttcagtttctttcttgctctttccttgagtgtgagtagcaaatgtgttcagattttacatattgaaaatgcctttattttgccctgagtattggataatgatgcagttgagcaggaaattatgtaaggacaggtttttttttttcctacaacactgaaaatattatttgtcttttgaaattttttgcctttaggaaatctgctgtcaagttattgtttctttatcattttctctggtacctttaaattttctcttcgtcctgtctgctctgcagtttcaccctattttgtcttctacagtttcactcaactttgtctgtgtgtaaatttgctttcatttatactttgtcacctggtgtgttaattagaacagatacgttatttctttagtggttctgcattgtctttgtgaagattttctttttcccaatctcttcattccttcctaagggaaaactttcttagagctattaagactatccccttcttatattccagttactggtttccctttaatattttctatattcttatctctatctgctcaattttggatacttttctaaaatctgtcttccaactctcaaattctcgcttcagctgcctgtggcgtaatttatccttcaatagagaaatagtctcatctttgtctgtatatatatttatctctctacatttatgtatgtgtgtttatattttttcaaaaaacatattttccatttctcaatattttattgagttgtttcacaaatctgttctttgttatggttttcttcttttttgtgattaattctatgtattcctttaaacaacttaaacagataccatctgtttgactgaaatgtttcaacttaatgagtaataaacatgacaccgtcttatttttccaataactacacccaactctgtcaaatttcaccttctgcctggtagttggcttctttaacaatatttctctgggatctcattactttttattcacttttagttattaaaatgtactctaatttaaatttaaatatcataacttaatcaaatatttcacaagtttagattaatctgttgcttcagcaatttatacagacgcaggagtgagaataaatggtctcacagtctcctcctccatcccagtttctggatacagatctactgtcgatataagggagggtgaagagggaaaaatactctcttcatgtgaaagtcctttttttgctgctcacaactgctgttcccttttgttaaaacccacacacatctataatgcctagtctgttgtccctcttctatatattatcaccactgacctggctcgttctctatagacttgattcgctctgttgaggatccagattggccttattcatatgagctttgaaccccccaaaaaagatctcctaggcttttatagtacctcgtagtgtttaacaagaatttcaagctgacgcttgtcaacagctttacacaaactgctcttgaatattatgtctttttaaccaatgctttagtgatgccctggagtctaatttacctaccatatctcaactcagagcctatgggcactggaagtacctatactccgtacctttcaggaatgagaagtttgaaagagttgtttttgattccttcttggccataccaacagctcaacaggaaatgaataccaaccaccccttcctgaatatatccacccagtagatgagtggttttgttttagatcctgtaaataaaatgattcagatgagtttaccctacctatccccataaaagggtgagaaagaagaattgcctaactattcaaactctcttcacctcactcccctcaagtctccgtcagctctctctgtttaaaccagggcttgtgaaaacaagaaagagatgatctcccaaaatgaaatgtaggcaaccaagccctttttcttaggtgtgaattccacttgccagtctcaagcaaataaactctatgggaaacatacaccatgaggctaggcatatttattgtacagttctccaaaattgttctattatctttatgtcataaggtatggattctaccatttgttacaactaatgactccctctaatggaagtgaatttccccatgtggctagtaaggtttttgtttgtttatttgtttatttgcgagctcatctataataggaattgcctttactggaatttttgtctttttttttctctgggctattgagtttttgtattgttgccatcaggattgtagagattttatgctctgccctcatgtgtgatacaagcttaagtttccgtttgttatgggtggatctttatttttcagcccaaaatcccccaacaatagtttccttgctaaatcataatattccaatggctagggatgttctacttcttccttacagggtggatggcacactgcttcattctttcccatttccctggcttgcctcatttcccatctcaagttagtgttaaatgccccagctttgatgtcgtataccctgttctgatacgccagtatttttataagcttgattttccactttctactttcatttccctctttttctttctcacacctgaggttctatatacatgttttacagatcagctatgaattaaaaatgtttcctttgtattttaacatgtattttggtataactgaagcaggatatgttgggagttacctcatcagctccatctactattttgaacagaagtttagttttttatttgtactttccttcaaagccactttggattctgtgatttcaaagtaattttaagatccaaactgttaagcttaacagttattctaagtggcttttagctccaattcgggcttcaagactatattttattttgcaaaggtgacctgtaaagctggtacattcagcctctccagctgtgtccttcagatgcattgaggacagaagaagctatccattctgacagttaaatcagcaaggtagttcattacctcaatctgcaccaaagttaataagacacattaccaatcacgtctccttgtcttcaaagctctaaggtaccctcgggtatttaagaagatatttatattttcccactgggatctttgcccagaatgaagacagcctgtagtccagcaggagctggaaatgacccagattttagatttctatcaccttttaaagcaaaacacttaatttcactttttgcaataaactgtacataagatatcaagcaggtatgaaaggttggtacgtttgccaagcaggtgagactgatacttttcatcagatagagatcgaatactctgtgtcattctaagggctatgaacatagagaactttgggaaatctgattaattttttagatccttctgaaataaatcttcctttcaagcctttaattttggtggtagtgaggcgggggcaggtggtagtaagtggtgatgattgctgcattgtgtttactgtacttataggttcattcaacagttacaaagctaacagaaaatgaccgttgttacattcttatcctctctcgcatcttcctatcttttccccaatagacataatcaccatctagaaagctacctttgttattcctttgtttaaaaaaaatccacacacatatgagtgaaaaaacaattgtgcttaatttcagtattacagtaatggtaaactataatatagtttttttagggctttgtctttcacccaacatatttgtgtctgagattcattcttatggttctttttgatgagatttttcattgtcacgtctgtattctctgtttaaagatgacggtatatttttccattctccttgcagtggacattatttccttttttttgattactacaaaaagggctgaaatgatcattgttgtaacagtcttgttatccatgttaaacagtttctctgaggatgcacatatcaaaaagtggagttgttgtcttgatgggtatgtgaatgttcaccttattgagaataacaaattgttttctgaaatggccatttcagtacacacacccaccaacaataaatacaaatttttgttcatgtatatcttctctcacacgtggaattgtcaaacttctcatttgtgtcaatcaacatggtatctcattgtaatcctggcctacatgtccttgattactaatgagattgaacatatcttcatgtttaatgtatatacatatttctctttaagattttggttcaggttttcttttcattatcgattgggttattcatcttctatttgacttgctggcatttttcatattcttatgtgttacagatgttgcagttgttttcttctattttgagtctgtttttcaattacttgatggtgtcctttgatgaatagaaggtcctaattttaatgtagtcgaatgtattcatctcttttttcttacggtcagttttttacgagatgtcttacttaagatattcttctctatgccaaagtcagaaatattttcttctatattttcttgtagaaattttaaagttctgcttttttatgagtacttctgtgtataaatcagtttcataatacaaattaatggccatttaaaataatcaaacctttgaattagtggtaatatttccgataatatacctcaaggaaataataagaatgtggaaaaatagtccatattcacgatgatgtttaccataaatttataatagcaaacaaaactaaaagtagtctatctaaaaaaaggaaattgctaaactaagatagagccactttaaagaagtcttagattttcattaaaaatatgtcttcttagtaatacagaaaatggtatgatataatgtttagtgaaaagagagctatagttaaactcacttaaattttaactatcaaattatatatgataaatttcagaggaggtcacagaatactggtaacagtgatgtgtgagggagttagatttacatatgcatttttacatatgcttttatttttctgtttcccagactgcaatgttggtgcttatttttattttaaaaagtaaattactgtcttttgaatttattcattattcatgtaataaaatgttttcttaatgacttttgattgtagaggtattagatgatgaaactgtctagctgcattttgaattacctgctacaaagtaaaggtgaaaaatacaaagtgttatattttcagaagttttaataatgaaatggcaaaatttcacatttacttttctaccataatatttaatctgtgatatatatttctttcttaggaagtttgggcatgttggcatgagttattgtcatacttggagaaagcaaacaagtggctaaatgaagtagaatttaaacttaaaaccactgaaaacattcctggcggagctgaggaaatctctgaggtgctagatgtaagttgtaaattaagccaaatgatgataatttatatgcagtattaaaagaggtcaagtaccaaatagaagacaaatccaaagaaaacaacccaagagagtataattactatgttatcactcagcactggtactttggataaagcctttgttccccctaataaccttctaggtcacaagattttgcaaagggtttaaatggcttctcacagaggaaatttgcctttattatatcactaagttctacatagatgcttcacctaattaaatgtaccacaaacctgcaaagacagtgtgaataaacaaactcactgctttagggctaatcgggatgataatatgaaatattatttccagtttaaaagctgcacgtattgaattggaacctattttatacttacttaaaatcacaaatttacaccttacggaatgttttgagttattaaatggatatgctttaatattggaaatatatctttaaagtattcataaaatgtaagtacatttttaagttttactttggagactttcaataattaaatgagtttgcatttataaacttgactttaacttctgacatttaatcattcaagctctatgcattttagtgtacttttgacttatctatatgtaatgaatatgttgttttagaatatgtaatatatgtacgtaaagctataagtagtatagcccctctgtaaatctataaaataaggagcataaattattcaagatgtgaagaaaatgtaaggtatttctttagacagaatagaatttgtaatcctagaacatcagagtagacacctatagatcattttatccaacttcctaattttcaaaaggaaattataaaacctgaaaagatattaaagtacaatgaagtagatctccagtggactttaattttggctctatctgactatgactataaatttgtcgtattcagagaagttaattgaccaaacatttcttgtgaatcagcaatgtgttacatgttctagaaaagttgcagcaaatttacagcacattaataaaaggacagtggccagaacagaagataggatgatgctgttagcctatgaaattgtcaaatcgtacatggagcaccatgctaaattcttgctctcacagtttcagtgatgtgctgaaaaactagggcatgttcacaaaggaatgttaaggaaagagagaaaatttgaagccataatgaagagcatttagaaaagatggggaaacaaaacttaccattactatttactattttagacgaggccctcacaatgcccacaacacagacaagcagggaggaggaaaattgcgagtgctcttatcttttatttctatgttgtggtcataatttcaaattgttcctaattcagataatggagccaataaatgaaattccacagtgaaaaaataaataaatacatacataaaattggctctttggtagtgttgctgatgcttatccaggaggacattttgagtgaaaagggctagatcaccacgtatcaaggatagaaaaactgcacgacttctaggttttcttgcaactcaagatatttataactgatcccttaattttgctttgttgcttttcatccacctttaaaaaaatttaacaaggtatatactttgttaagacttataaaataatgtatccattaaaattatttatatccattttgcaaataaatatttacaaaattaagatttgttagaagtaataaggaatataaattattaggaaaattattaacaatcacattgttctactcaaaaatttgatggcttttaaagtattttacaggttatagtgattttttttaatataaatgtatttaggaagtctctttattttcttgaaacttaataggacaatgtattgagtttgctcaaaattcaagaaaaatacataaacaggaaaaattacaaatatgtattggaagattttcatttttttaaaacaaggaaaacagaagatttaataaatttgtgagaacatatgcccatcacttattttatagatatgtttgaggtccagtaagatgaaattgaatcccttgttttctggcatgcctatgacactgagattcactttcatcatattatctagccaggcaactttgtcaattttgagcagtataggagatgggtattattgggatgtacgtaacagagaatcagacaacggtttaagctcacaaaatgatcttttctcaccacgaaaagaatagtgaagggaggttactcagggttgaggatggttcagccatattatgaggcgagtaggcactctctgctctctcttcctgagcatgaaggacctcacactcaaagtcattgcctcccagtgcaaagatgattgttatacctccaggccatgtatgtgcaaaaaagtaggaagggcaaaaggattcttcttgagagagtactctttttcagaattgtgtcacgtggacaccactagctatcagagaagttgagaaatttagtgttttacctcttctggttttagagttaggggacgtcaaggaaaaaggtggttgtgaatcaagttttaagttctcagtccgcaacactgtcataatcccatgaagattcatatagaatgacatcctattttttgaagcaaaaatgctccttggtgtttttaatcccaattaaaatttgctttaaattgattatgacttaattatatgtaaatcagaagatactgagcatttgctgataatccaatgtatttagaaaaaaaaggagaaatagtaattattgcaaatgtgtttcagtcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggtatgaagataagtgaaaaatctctttaatctaatttgcattaatgtatagcagatacaggcctctcagataaaatgagcaatagtttaaatattagctcagctttcaggtttcagagacaatccaatgccagacactgggtaaattctttacatgtgtattatagcatgtgatttcacaaaaacattgtaagttaggattcttaaaaggcaactgagacatcccaagaaggttactctgaccacagagttcttttccttactcaagatagaccagtatgtgtgggtatcctttctctctcgctgtctcattttattcctctccctccattccacacacatttgttatgtcacatgtaatctgctaataatacatgcaattctgttagtaccccatattatttattcttcataaataacactacatttcttatagataaattttcatatatcacacatggtgtgatttttcaaatcaaaactaaaacaaaatagcaaatttctcctagtcagtgttttgcatactatctcctaagaatggattatttgtcaagaagaaaacccattttataatgatgtttagttttatattcacttactgagtacatctactacatgtgagatatggttctatggtttgatgagtaggaaaaatttgctaaccttcataacttaaaaacattggttagttaaggaagagttactgatttcctagaatgtgcaagacataaaaacaaataatataacgtatgaagagaaaaaagagaataagggggggtagtaactagggtagtatgcatgaaaccattgactaatgacttattgaatagtcaatgtcggggaccttttgacatgcttacagattgaaaaggaacgccttgagtaggaaaacctcttctctatccaattctgaagagaagtatgtgagggtagggcagatatctgcaaatgtaccagcagcacctccagtcttgaatcctgggtggcatatccatattttatccaaatcaacataaggaattggggattggaaaaggggaattccaaacaatctctggtccttcatcattgttgcactattgctggatctgagtcaaatagatattgctatgtggcaagtaaattgaagatcatttcaatgtgggttgtgatatggaattggaatgtgtttttatttctatttgaatatcagtgtcaggtaggagacagcagttgcatcaaaaaattaaaagtcattgtgaaactgaccttggcttagctgtgaaaagactcaaatttttttttttttaaagacagggtcttgctctgtccctgagactggagtgcagtggcatgatcgtggctcactgtagcctcgacctccctgggctcaggtgatcttcccacctcagcctcctgagtagctgggactacaggtgcatgctgccactcccggttatttgtgtgtgtgtgtgtggaaatgttgttttgccatgttgtccaggctggtcttgaactcccgggctcaagctatccacttgccttggcctcccaaagtgctgggagatacacctggccaagatccaacttcagtgtttgacatttttcagtactcatctattctgtccttaggaatagcttactctctaacttgatcttggtattaactctattaatgtaattatattgcaatcctttattaacacaaaactacttataaccttctattttaaaggtttttggtataaaccctgacatttcccccaaagaaaaaataattcatttcagcaacataccctgattcaacacgtattatcttattttctggactgagtttttaaagcataaacttttgaataagaaaatacttgaaacttgggctagaataacaccttgtattagtagtcagggtccagacagggcacagaaaccactcagtcacttaaacagagatggtttaacacaaataagtattaactacttactggaaattaatttttaataggaaataaaagagatctctaaagaataccttaagcctgaggaatagtacacaaacaaggaactaatatggaaagataggagctcaacccaaggctggattcaaacttctttagaaagtgtgtgtctgcctcccatgggatgacagagaagtttccttcattgacccaatccagaacaagtctatagccagtgagctgaagctagtgtgaagagaatattggaggggaatgctgacaaaattcacagggaagtagcctatggtggggaaccattgaatttgctagaaagctgtctggtgtattcattggacatggtgggaaactacctgtagtggatgctactaaacttgaggaaatgaggtggggctccaggaagctgcctatggatttgccacccatcctcaatttgcttattgggtacccatagaacttgtcaaacacgacccatagtgttgctgaaagtcttctgggtaaagtggggtggatgaggtgagccttactgggcattccataggccagcccagagtcacaggtttgaaaaagaattaaaagcacactgggacagacaaacctctacctcccccattgtcactccagcatcctttactgacagaacttaatatcatgtcagctggcaaggggagaaatgttcccgtgtcaaaaacaggatcatgttgaaaggcaaaaaattgataactggcaaatccctctgtaattcactggctatgtgattttgagtaacagttttaaacttacgtttcctcatcctgtttcatagggggttttttttgtgagcaaaatataaaatacggcacttaaagtactatggttccaggaacacagtacatattcaataaattattcaataaatttaatacatgatcagcctttttattttgactagatgatattctagagtatcagccctcaaaaattgtgtgtgtgtgtttgtatgggtgtaaatatatatatatatatatatatgtaagtatatattaaaatatgtaaatatatatttaaaaatatgtaaatatacatatatatatatcccactgagggcagtgattggtaaataaatgcagatagtgcaatatgaaatataatgaaatgcacatgcctccattagttaaataaaatgtgaagacagataaaaaggatttttatcaccctctaagtcttaaaatcagaagctctccacttgtacctcaatgattaagcagagtgttaaaataacaataaatctaaaataagtaaacttgaaactattatcagtcctagctgtgtttatattacatatttggccagtaataacctgggagttatttgacaatgaaaataaagcatatttagtttttacggctttcatgaaaaccacatcatgttaaacataatatccttctcaaattctgttgtatcagcctgtgataagctgattagacctgaaagatacaatgttaaattaaaacaatgtgtagtaataggacttttgtatttctcaggctttgctcagcactttgatcaatttcaaactacttaggtaaaaaagacacacctaataatttattagctaaatcaatcctttggatatttccactatctagttaaaaagactgttgtttcgatgcagtagaataagccttgggataaattatctgagaggctgaagaaacaaaatgattacagtaactgagtttttaaatcaatttaaaaaattcttgttgtacattaatgtgttataatcaagaattctgaatttgttttaggccatgattctcttgatttttggttggttaaacaaaaaagtttttattttgtggttattttctatttttattttattttatttttttgagacagagtctctccctgaagcccaggctggagtgcaatggcacgatcttggctcactgcaacctctgcctcctgggttcaagcaattctcctgcctcagccagatttgctattaataaacaaagtgccttttaatttgaagatgagccttaacctattttttaaaatcaattaagtgcctatgtcagaggtttgtgaggtttttatatcacctacctaatgtttcttatagctgcaattatgcagaactaaggtaacattcaattgcctgttaaatcagtcaaacagccagacttttattgcctatgaatatttaaaagagatttgctagatcccatccctaatttcagagtgtgagtttgcattcaaataagtaataaattatttccatcacttcaaaaggcatctttcattcttgataatcatatagcactatattttctactcacagtaatgatttgaaagatggttagcaaaccaggcaacatctccaacagacgtaccaaatcatatcatttttacaactattgtaatagctttattctctaacagggtaaccaagcagcagaagatgatttagtaatacaacaaaatgaataataatattggtaatagtatttggttacagaggctcaggtacccttttaattgtcagatatgcattttctcatttagttctcacaatagccttatgatacatggtggtttttgtttttgttttttctttttttgagatggagtctttccctgttgcccaggctagagtacaagggtgcaatctcagctcactgcaacctcctcctcccgggttcaagcgattatcttgcctcagcctcccgagtagctgggattactggcacatgccactacgccaggctaatttttgtatttttagtagagatggagcttcaccatgttggccaggctggcctcaaacacctgacctcaggttatccgcccgcctcggcctcccaaagtgcttgaattacaggcgtgagccaccgcatccggccgatatatggtttttcatattcccattctacagaaattgaaaggatattaaaggccctaggaaaaagctattgagcatttagacccatctctttacacttgaagcctaggcacgtgaccatttggctacactacctccaatctctgtgacccttttcatatattaaaaataaaaactctgctaataagtgaatatggcaattaacgagtttccccgtttttaaggaaagcttaaaacatggccttaaaagtattatggctgactaattaaaataaaatttagagtcttaaatattaaagtcacacattgagaagtccaaagcctttaccacttctcttgatgagtgattatttcacctctttcgtggcttattaatgcccgtatttcagtccctttcaaagatgtctgtaagttgttatgcctgacatgaaatagcaaatttactgaaagggacaaaatctaaattggttaattcttctgtaatagtaacatttatgatagactcagagagggccgtattaatttttcctggtaattatgactttgaatttttccctcagtgtcacatctaccttagcatagatagaccagaacggaagaacattgcttgaaggaagactataaagtaatctaggaaaataagtggcatattatgctttattaatttgtcaatatgttttgtagacaatatctgtctataataatagtaaaagccattactttttgagcacagttttacgtcagtccttttgctaagccgttagaagcaacatcaaacttaaatcccacatttgctttatgaaatagatttgattagcttacttcacagttgttgtgatagggctgacttctgttctcaagggctaggacagctaagtcttctgtaatgccctctggaaagcactaggatgctggaaaatgtctagtagttgtattttatgttgctttcaaagaagtataagtaaacctttaaaggctaggaaaaaaatcagatgaaactgaagtcatgccgtaacatgcctatgaccactgacatttgtatggtggagataaaagctaagactgggaaccccaattttaggtgaattaagtcatttgatggaaaagaaatatgatcctctggctcacgaaaatggtggagctaaacacagattccacataaaactggggttctatcagtaagataatgggcagagagaattctatctgcagagagaacaaacataaaaagacatctgtcttctcactgtgagtgcaaagtaatagaataattataataatgtcacctgaaaatgtgtgttggcctattcttgtaaggtgaggaactcttgagtgtatattatcacaaagggtaaagaaatatccaaacaagtgattaagtcagggtagcaccaggttaggagcgtcctagcattagttagaagcaaatgcaaattgtttaccatgaaaagtgccctcagtgtcctcacagattaaactcaggggaacttgagctcatcataaacacatagacatacacacactcactcacacgcacaagaaaagccctcatgaagcacagtcagcctatacaacgaacggtgagtttacttctagaattccggatattagaattgcaagatgtatagtataaaataaataggtaaaatattatagaaataaatgttattgaagttataaaaaagaaaacattgtaaaaatggaataaagaaatcaaaattaaacaactacaattaaaaattagaaaatgaatatatcatatataaacatattagttgaaagaaatgatttaaaagaaaactaaaagagaatgtacagactgtgttaccaaaaactaaggaggtggaagatgtgaacaataggtaatagatacaggggtggggagtagaatatgaacatataacttatctcaatgggagttttcaaagaggagaataaagaaaatggagattattattattcaatataaaaaaattatataacccaatttaaaaatgagcagttgagctcaaaaggcatttcttcaatgaagacctacatatggccaacatatatatgaaaaggtgctcaaactcattaatcatcagggctatgtaaatcaaaaccacaatgatatatgtcttcacatctgttagaatggcagttacttaaaaagaaaatcaagagatgacaagtttggcaagaatgtggagaaaagggccccttgtaccctgatggcaggaatgttaattcatgctgacactatggaaaacagtatggagattcctcaaaaaaaaaattaaaaatagaattactatatgatccagcaattccacttctagggatatatccaaaggaaattgaatgagaatcacaaggagattatctgcactctattgtttattgcagcattatttacaatagcaaagatatagagacaacctaaatgtccattgacaggtgaaaggaaaaagaaaatgtgatatatacatacaatgaaatattattcagcccttaaaaaataagcaaatcctaccatttcgctgtaacaacatggataaacctggaggacattatgctacatgaagtaagccagacatagaaagacaaataatacatgatcccaatcatattatgaatctaatacagtcaaactaatggaaggagaatgtggaatgcttcctgccaggggctaggggaagggaaaaatggagagatatttgtaaaagggtacaatgtttaggttatacaatatagataattcctagagatctactgtaaagcatattgcctatagttagtctatttacttaaactttgctaagaggatagaccttatgttaagtgttctgttacagaataataataatattagaataggaggaaagttttggagatgatgaataggtttatgtcatagattgaggtaatgtttttatcagtgtatatttatctccaaactcagcaacttgtgtatgttaattatatacagctttcttgtatgtcataatttttttgagaaatggagatggagtaatatatgaaggatattaaaggaaagtttccaagagccagtgacataaaccacttaaacagaaagcacattatataacaggcaaagtaaataaatagaaatccaatctcagacatatcacagtgaaagtgcagaaatccaaagacaaatttatattagcagctagaggtgagatggataacctacaaagcaattaaatttaggctgtcattagacttcttatctacaacaatgaataagaataaaaaagcaatggaaaatattttcaagatattgaaaaaattaccgtcaacctagaattctgaactcaacaaaattagttcttcagagtaagaggaaattagacattatcagagtgaaaaaaaagtgaaattttaccccaatagacccttactataaaaatgtctaaaataagtatgaagaattagaagtagtagaaaaataagttttaaaggttttagatgcaataagtatgatgaaaaaatagttaagcttttaaatacaaaaggcatttgttgcaaaaaatatataagaatatctaatttcatttaaaataatgttgatctaaaatactagattaaaaacaatatggaggggagttacagccacaagcccttttatttagaaagagggtagagatagtgattaaatgtcgactttatgctgtaataaattgtcaaggataaccactaatggagcatccacctgggaaacaatcaaagaatgataaaaggaacagttctcaatcagtacgcagtaaagcaagaaagaaggaaaacaaaacagaaaaatgtgagatgagcataaaataaaagaaaagatggtagaaaaatagaaatagaaaaaaatagatggtagaaaaataccagcggccgggcgtggtagctcatgccttaatcccagcactttgggaggccaaggcaggcagaccaggctgccaacaaggtgatacctggtctctaccacaaatacaaaaaaaaaaaaaaaaaaaaaaaacccaaaaaaaagtatccaggcttggtggtgggtgcctataatcccaactactcgggaggctgagacaggagaatcacttgaacccagggaacggaagttgcagtgagctgagatcatgccatttcactccagactgggtgaaagagcaaaactctgcctcaaaaaaaaaaaaaaaaaaggaaagaaaagaaaaagaaaaaaaaaatacatctgtagtcctagaactatttgctcaatacatttaatatataaatgtagaaattttcagaataaagcatcaaaattcaaaatacattgtttttaagaaatacataaagacacatatatcgaaaatggaaacagattttccgaaaaggattaatcaataaaaagcttagacacctaatttatttccagcaaaatagacattatggtcattatcattattaggcaaaaaatggagtaaaatataacagttctaaaacttgtacatacctggccgggcatggtggctcacgcctctaatcccagcactttgagaggccgaggtgggtggctcacctgaggtcaggagttcgagaccaatctgggcagcatggtgaaaccccgtctctgctaaaaatacaaaaattaaccagctgtggtggtgcacgcctgtagtcccagctgcttgggaggctgaggtgggagaattgcttgaatctgggaggcagaggttgcagtgagctgagattgcagtctccactccagcctgggttacggagtgagactctgtcaaaagaaacaaaaaaatctcgtacatacctgggaaaatacctttaaaacacgtaaagcaaaaatccacagaataacaagaagaaatacacaactatatcagcatggtgggagatttcataatgcctctttctttcaagacaccagacaaaagttagtgaagatagtgatgattaacagttgataaggtggatataaagactgtatagagaaccccaaatcagagtgtaaatttcatctgaagtacatggaaatgtcaatacatttcacatatttggtattattagggaaatactcttaaatttgtaacaagctagaatcaatagtaaaaacttgactaaagtaaataatttgtggatcaaagatgaattcaaaatggatggttaaaattcatagaaccgagtgataataaaaataaaaattaaaactaattggttcctgttaatttttgtagaagagacggaagggctgaaaactagtgagctaactgcccatctcaagaaaatagggaaaagtataataaatgcagagaaagtaaatggaaagagaagaattcaagagcagaaataaataaaaacaacatggaatcaataaaatttaaatgcccatattcatgttttaattagacaaatcaactgagagggaagtaaaaacaaatataaaatcttaaggatgaaaatgttataactacagttataatatatttttaaaatacagaaaatactaaaagctatgcaaataagtttagaaacttacatgaaatggatgaatttctaggagaatattgctacaaaaatgatggaaggggatatagaaagcctgaggagacagaaatttaatcacaaattaaaagtcttcctacaaagactatattagactgaaattattttacattcaaatttgaacacactttctaggaatagataattccagtcatcaacaaactcagtagaacatacaaggcaatatacatgtctggaaaatataaggttagaaaatttttttttttttttaccaaaatcagacaaaaatgaaacaggaaggaaaaccccatgccaatttcagtcataaattaataaggaaaagttctgaaacaaattattggccaactggatccaagtgtgtatgaaacagtgtttaagcttaatgttctccctttcctttctatattcactctttataatactttatgcagtgtcatggctttaaataaaatttacatgctaattattcccaaaatattatctctggcacagacttttgcccttaacttcagaccatatatccagccttctattgtgtatttttctctttggatatctcataggctactcaaacttaacatactcagatgacagctcctatcaaagctacccaacaccgttttctccacctctgttaatgccatctcattcctgaaatttctcataccaaaacttttaaaatgaactttgattcttgtctttctttaccagcctttctcttagcagatctgaaagatggtctcaacagatctagctgttgttttacttttatgttctgggtatatatgcaggtttgttatacaggtaaacagtgtgtcatggggggttggtgtacagattatttcatcacccaggtaataagcatactacctgataggtattttttctgatcctccccttcctcccattctctatcctcaagtaggacccagtgtctgttccctcattgtgtccatgtattctcattatttagctcccacttataagtgagaacatgtgatatttagttgtctgttcctgcattagtttgctaagtagaatggtctccagctccctccatgttcctgcaaaggacacgaactccttctttttgtggctgcgtagtgttccatggtgtatatgcaccacattttctttatctagtctaccatggagggcatttaggttgattctgtatctttgctattgtgaatagtgttgcaatgaacatatgtgtgcatgtgtctttgtggtagaacaatttgtattcctttggctatacacccggtaatggggttgctgtgttctgtttttagctctgccaaactgctttccacaagggctcaactaatttacacccccaccagcagtgtataaatgttctgttttctctgccatcccaacagcatctgttattttttgacattttaataatagccattttgactggtgcgagatggcatcttatcgtggttttaatgtgcacttctctaatggttggtgatattgagcattttttttcatattgttggccacatgtgtgtcgtcttgtgaaaaatgtgtgttcatgtcctttgcccatttttaatggagtagagtttttaaaataaatttgtttaagttacttagagattctggatgttaaacctttatcagattcacagtttgcaaaatatttctcccgttctgtagtttgtctgtttactctgttgacagagttcaacagaggaactctgtgaggaagttgtgtaatttaattaggtctcatttgtcagtgtttgcttttgttgcaattgcttttgacatcatcattacatcttttcccattcctatgtccaggatggtattgcctaggttatcctccagggtttttaaagttttgctttgacattttaagtctttcattcatcttgagttgatttttgtatatggtgtaaggttttattcttctgtatacggttagccagttatcccagcaccatttatggaatagggagtcctttcctcattgcttgcttttgtcggctttgtcgaagatcagaagggtataggtgtgtggcattatttctgggctttccattctgtttcattggtctatgtgactgtttttgtaccagtactgtgttgttttggttactgtagcactgtagtatagtttgaagtcagctaacatgatgcctccactagctgtatttctttgctccttctctcattaaatatagtctctgtgttccaaagtgaggaggaacaactgtgagattaagatttggtaaaagagaaaatgagcagggcaaatagagacaataaatctgtgatgatgaaaaaatgagaaagaaaggccagtaactgaaattgaatagtaatagggcagaaaagatgtgttgttgattttcaggataataaaaatttaagcatgtttgtagtataagggaagatccaatagaaagacataatatataagagcaaagtcttacaagataggatacacgagcaaaaaaaatggaaggattgactttggaagtgggaaagagaaaattgagataatacaaggaggttctgaggtggagagtagtaagtttgagaaagtttatccaccaaggataaatttatccctgagaagtaggtaactctgttttcaggttgtttaggactctgcacggtaaagggggttgggagaaaggagaactggtgtcattgaggaaatgagagtgaaaagtatttggaataggagctcttttgttttaaagattcgtttaaaatcaggagaagtgttagagaataatatcgtggactcagtagtagccaatgaagttattcgcaatggaaataatcagttatctgactttctcccgtaattttctgcaaaataattttatttagaaccacacacatacagccgcatagaaaatcaaaagcgaagggatttttctttgcgttatctttgattagcatctccaggttgtatttgattatattctgaaacaactaggattctagtctgaagtatcttcttccaactatattcatatttgcaagtcattcatctggttaccgccagtatgtcaaatgtgaatttcatgtatttttttttttttttttacaatctctctaacttaaccaatttaattcagatttttatgtcagtcttttagctgttggctgtttttcccaaaatgtcaggatcggctccataatttgggggactcagggaagaaagaaaatactgggtcccatactcaaaaattaagcattgtaagatggcaacagcagagcattaaaccaagcatgggctctcctaagcatgagttactgcataactgcacaggttgcatggctttgaagccaatttcgggtgtcatcttatacatttggttatttgtacacctgaaatgcttttgataaggtttgggagttaacaatttaggctcacttttatagattatcattacttgaaaatatttcattgaggataattaattaacaataaatgctttaatatttagaaaggtgaaatttaatcttattcttagtgtgttaataatggatatagcttctaggtttacatctttccatactttgaattcagggctttctttccttaagtagtaaaaaggatattggatatcttgaatcttgacttctcctaggttgaatgctctgcaaaaaacctttgtctttatataaaaattgcactgcaagcagactattatggcagacctctgtgttcaaggtgactgcaattttcagctgagtggtggactatgcaacttgttctcataataatattaattgaataaatggtcaagagtgattacattttgaggggaagaaacccacttgtgtaatatttacacatagataataaactcaatagcccagacctctttaatgtaagaaaaatagacatgaatgtgtatgctattttctttgtaaattagaaatttttccttctctatttcatgtatcttcttttgttatttgagaaagggatttttcttgtcctaccatcaattgtgtgagttaccttgattcttgtttttaataatattttaaaatacatcttgtattttaaatgtagttaccctctattttatagctacaggaactgaaagagtacatagccttcacaaaagggtctgtggtgaatgtgtttaattcttattttaatcaccatgaatcatggattttttctttgtaagtagtaattccattatttttagatataatttaccctacttcaatcaataatgtttccttggacagtcatatttacttttccgaaatattatataaaacagtagttaaatgtttttgttcgtctgtatgcctattatagaatattagcatttttggggtccagacacaaagggacacacaaacacatatatatacttgcatgtatttatatatacatgtatataagcacatatgtatacatataatcatgtactgcatttcaatatatgattaatatttaagtatttaatattcactctagacaaattatgtttgctcttggagggcattaatatctttgtgaatgagtgttaacatatccatttaatggtatcttgtcttcaaatatctcataatttgatagttgagttatttcttctgaagttggaatagcttttctacaagggcctaccaaaaaaaaaaaaaaagaataataaagttggaataacaaaagagggagttaatacataaaggaaaaccattaaggccgaaaaactaatcagttgtaaaagctaaatcagtagtatggattgataaagtagcattttagtgataaatttttggattgaagtttctcttttaagtttatcaatgtaccttttcagaaaaattcctcgagtttatatctttatgttaatgaaacttgtcaataactttaattatctatgatgattgacaactaatacttaatttctataacacacaatactgttctgagggtacatattcatctctctctttcatcttacgttttaccactctcaactttttaaaaccgttttctttgcaagctacttcatagattcttgagattgaataatcaaatctgttatttaatattcaggccaaatttctgaaaatgtttatttttttaaaaaaaatgataaatggaaaagggaatgttaaacaacatttctttgcagtgtattccagtgtccctagatggaatgaggaataaaaatatttttcaagttcatcatgctgtcttttaaatcataaaatgcatatatttattagtaatttttcattgaaagtatcaaagaaaattggagaatttccttactgtttctacctcactatgtttcgtatattctgaccagcattaataccaatttcatagcactctactgttcgctcttttttgctgtaagcccaactgattgcattttcttacctgttatttttcgttgttgttatttaagacatcttttctttctaacttcggtcttcatagaccttctcaatttcagctcatcaccaaaattacacagatagaagaatatagggactttggtgtacacatacccacttttgactccctctgattttctaatttagtagattttaattgaggctgagaactgtatttggaaaagttcattctgatgattattcaggtttgtgaaccccagtctagatagacctttatcagcacatgtataaggtgcactttgctaaggtgcattatgtgtcaggttcattcccactgtggaccagtaatttattcttgcccaaccactgctcatgacagatagatgatctctgtattccagaaatgaagctcctttccaattcctcaacaactaaaccaagcagaggaaaaagtggttttccttcacagccatagttccctgctgaagtagaatgaacgctttctaggaaactgcagcagatttttgatgacacggaaagggcatcactaggatcctcattatatattacctctctccctcacccgaaccacaatgttgacggaacagatacttcctgtggggaagatgctaagcagtcctgcatggctgtaggcattgtccacatcttaatcttcagctatatctgaggtatgacaagtttaacaatcctacaagttaaagcgtcacaccggaaacctgtttattcttctcccatgccaaataattccagcacgatgggtttcatctatagacgatgagaagatgccattgtggggtgaggacatagagaagagaggaagtttggaaccagtttatttctatttcagcaagcttaatgtattgtaagaacattttgtggcagatgaccctagtctgtaacaaggaatcgattgtaatgcatcattctgccagtgtttatctgttccctatgctcatataaacacacgagtcatctttctgcactcccaacctactcctaaagcactatacagaatgtttcgaaagcagaaggaaaagcagctgttccatacaccatgttcctgctgttcaaggtgcacatcccatccaaatgaatcatatcagagccaaagatcctggtaggagttcttttctacaaaactgcagtcttgtctatcctaacaacttggaggacaaaatattagaaaaccttgtaataaccttaggacacaataatgtagatactgactgagctagacctgaggactttttcaatgtagtgtggataagtaagatgacaggaagccataagcatactgtgccttgcacatcaacttctccagagccatgacaatcatctggagtatttgtgataaataaatattgttaatcttcatgtaattgggtaggatgaaaaaggaccagtcgtcccagacatcccaggagagaggagcatttttccagttgctcagatacaatttcaagttcgaaccaatatgaattacagttgaccacagaggccggcaaaatccatggcactgtagtccaagagaacctgaacactggccttagagtattatgagcctacatcacagtagaaggaatccagcagagatctctaatgcacatcagaaaagcaccatttctagttatcaaggctgtatttcacactgcttgactgaagattggaaactattttattcataggcaacctgtgtggccatccttacctggtctataaaaggaagtgtgatgaatttgcttcccatacatcatattaagtccagaaagccagagatgctgtgttgagtttctttcctgagagtctgaattcctaagtagagggactaacgagttccaaagttctttcactctgagatctttgtcacactactgtactgactggatatcactgaccttatttaagaggactatcaactggctagttcatctacattgtaaggactagtttgctcacaaccaccaacctatctgtaattggcctcagtatgctctctctcacttgggtacttctgtatttggctaattaacctataccacttggcttagaagcaccagctacattttttctaattttgacttctcatcttttccaacttgattttatccccagatttggacttttgtctcatgtataaactttatattttgcttgaacatgtggtctcaatgctgaccaagtcatccctagaatctgattctgtctcactattccatatcaggagacagcgacttaaatattttaattatttcctgtatcaataaattattcactgcctaaagtttagactttaataatatgaacacatgtgcagtcaaagagtacctcgccattgggccggaaaaatttcactgacttagggtggctcctgaaggtaccttgagaaagcttggatatgatgaatcctgtagacttattttatgtttactgaataatgcttcattcactttctttttgaagcttaaataaagcatcagtttgctcctgtcagggcagaagaccaatttcacttgtctacccatgaggataaatggatgcagcaagaatccagaaatgtcttagatatattactctatagctcattgaccattctatcaatgctcaatgctttacttgaaagtgatggctatctgatgtcaagttccattgataaaatgattcccaaacgttactttcaagtatgcttccttcagaggtcacagaagaacttcagtaacctgctaaaacctaaaacaggtgaagttcctattaaccatgacaccaagagttttcacatttatattctttcctggtaaagaaaattataggagctccatgctcacggcttttgagttttctcccaggtgtgttcaaacctagtgacattaacaaaacataaatctagaagcctttcgtgaataatgtaaccttctttattttatatttaaaggatatatatgcagacatgtacacatctttgtaattatttaccgcctatatccctattaaatacattaacaaatatgccacaggaaaaaccactgtaccaaagcccctcacaagagttatatttaaagtgggttaaagcaacatggttttaatttacttagtctttcttgtccaaggaacacagtgtgagacctcctttctttaggaaaaaataggatgaactaatttgaaaacaaagaaagcaacaaagtgaatcttgtgatgagctatgagcattggtaaattatttcttctgttgtaaattatcctcttctccctctgcttttctcttaatctccatttaattcccttttcaaaatcctaactctattctttttggaaaacatttcattaagctggtataagcatatctagacatctggaaatttttgtataacttttaaaggatctattacttaacaccatatgaaattatggaaaataaagtgttcctatctaatcaatctcaaagatttttcaagtgtacaatacaatgtgtgcttcaagtgtcagcttcttttttttttttttttttttttttttgagacagagtctcactctgtcacccagactgtagtgcaatggcacgatctcagctcactgccagctctacctcccgggttcacaccattctcctgcctcagcctcctgcgtagctgggactacaggcgcctgccaccatgccaggctaattttttgtatttttagtagaaacagggtttcaccgtgtcagccaggatggtttcgatctcctgaagtgtcaacttctttaaggctgtcatcttgccggttctaaacaactaaaaattgtaagaaccaatttctgagacaaatagaacattcttagtggtccttaaataattcctgatacttttatggcatgcttctttaaagaccttagaattatgcttcaggaatttaaattggttgttcagcaaagttaccaatcagtaggcaagttgttgcatttgacaggagcaatagttttcacgtggattatttatattcatgtatgttggtagacggatataaaacatgcaacttgcagttgcatgagacaaaagcatcaacatatctatcttagcttttcaatcatgtgatactactataatgctccatttttcacagatatttcttaagttctttatctcttcagacctcccgtaaaccattttctgtcttctgctggaccacattctagatgatctggatgtctatcattctcctttgcctttgctttatttgagtaagtgctgaattcgtggactgtgttagtagtttgatgcgtagtttcagccagatagatcagaaacatgaaatgcttttacatcatccaggtagatggcgccatgaatagatccctttgctttctggcctctgaggtaataaagacttaaatctaattgggttcagcttaaaatctcaatgtcatatttaatttaatatgcttccttgtttccagctcaagcttaagccatggtctaaaagactttctctggaaggcaagtgtggttagattccatcttacacctccactgcctctttttcttttttttttttttaactgcacttcagttatattattctccaatgtcttgggaagtaggagttaaggaaaataggcaaatgtctcctgttaactagctatttgtagctttgagtttatgatttgtgtgtgtgtgtgtgtgtgtgtaacagagatacaaagttcgggtttatttggggtacaagtatgggatctttaagaagtcttgcagaagctcttttgttttccccatctttaagaaggaaaatatgctctataaaaacatcttcaagcctcttgatcctgaggtactcttgctccataaagagtgttcctggtagatagctcaaacatggctgtcttcttccacgttcacttgacctattgagaaacgtttgccacaccaagcactggggagtacaggctgccccccttcttcactgtatcatttctcattcattttttacctatcaagtaggcatataatttctgaagcagacatcttcagaagcagagttggtaattaggtgtcatccctatctactctggactcccagaccctgtgatcagtggtcttggagctccacttacttgcatgggacaaaaaggttgaagtaccatcttcttttcccccttacggaataaacagagggagccatccctactctccctctgggccatgaattcagaagaccgattctttctaaaaccttcagagagttttagtataagtgggtatggtggagcaacaaaggcagggccagttttcccagctcttttgtaagccctttgctatgccctgctatttccatctcttagaatgagagagacttattacttgttattttcagtttaagactatacccaaaattctaagacaacagatagaattcaatgcattcatatccatagtgacagtttcacacttgctcttaagttaaatagaagagttaggtcaggaggaaatagtttatcaaaaatgatatacacccaccagtattcttagtacttggcacttgaacaaattgcaacctgttagtaggtaaaaaagaaacactaaaaggaaatagttggaccactgaactattgcttgatccactgaagcaagtgttgcttggtccactgaagttgagactctgggaaagaaaacttgactggtaaactctgtgaagtgaagcgtggttgtcaaatggagattaatgtcctctcatgggtctccactgtagtttctgaagggcaggttgagtaggatttggttttagcacatctcttgcaggactcctatcccaagacactttctataaaataaaacatattccatattgctctactttctgcaaggtacggacagtcaggttggggccaattaatgcactaccctaagcagaaacttcaagactttgtcgttgctttgctttatttgaattggaatttgggatttagttttcgttagttcatttactactaaaatcactcataaaaatgagggctttattttgacattggcaaaaatccttctttactcagaagaaaatatttaaaactgctggaaattgaaatgttttacatgtctacatcacaatgatgaatacaatgatgagtatttaaacaccaaaaataaaagtgtcttattacgagatgattgtaaacagtgcacccacattcttaatccatttgcaagcataagcttacccatcacctcataaatgcagtaaaattgctttttgtattgagtttaataagtatagtataggatacctagctcctttaatgaatgtgttttttgtaaaatattattaaatgattttttttctaatttggctttttaaagcatgcattcatatgttaaatacattttttggtttcaatattcggttttttatttcacatgcagagttttctcttccagagtttcttagacatgctacactttgatttatgtgtttgtaatattgtggtacaaaggttagtacattatttttaaaatggaaatgtgagaaactgtcaattcattgtagagatgactttacattgccagcaaaactcattaaactcttaaaactttttcttaaacttattttatatttccatagtactttaaagatataaaataattaatttgtgttaacttttacttagttttaattttcattgaaaactgggttaaaatatattatgtgtttttcttggtaaccattactaggattgttttctatttttatatttttgtcattgatcgccagttattaaaagatgtctttctaactttccttatatttgctgtttctgtctagctatataattcctcttactgctaagtggattagctaaagacatgaaataacattttaaaacaacagcggaacagtattctggaacaacaacaaaaaatcagattatggttgaagactttctacaaacttcattcaatgagacagcacaggtcaagcgggcagaaagtcagaaaattcataagcctgacattccatcagggtgcgcctaatcagatgtttagaaatagaaggcagcttatgccatgactagttgaaagaattctgcaagcttgcattgacatgaggtcttttcaatgactgagataatcaaggaatctgtgtaaatcagcctctcttattgactgtcaggccaggaaaagagccaacccacccgaagtcaactctgccatcatttcttaagccacactgttcctttcagctcatagaatctcatgaatagaaaaagttaggtttctaaaaagaattttgaggctagatatgtggtttaatgttattctatattacatcctatacaattaaaatctacagatgtgccttgtagagtacactgtttttgcctttagccagaggaaggaccaaatttaatacctggctaggcaattattacacgctgtgattggaagttttctccaaccacctgtcacaatgctgaaattttatcactagagatccatttctttggaagagctgtgggtaggctgcagccagtctcctctgcaatagaggctctgattatagccctgaacactgttatctgaaatagtaaattacctgatgtaaattttagttgaaattttgactgagaacaaaaggaagctatgtttgaattggaatatagggcaaagcctcggtcaccaatcttggatacagaattttaatagaaagagattaaaattttctccaaataatgtcccacccccattctgacacttttaatacaaaaacagatagatttattgtccaaaagatacatctctgagcagtggtgacctttgtttacaatttcttctgtaaatccattttcgtctttgactatttaaagttttctgtttttctcattaaaatttctccttatacttttcacccagtcataaataaagctattgggcttcattctaggaactggtattgagcaatgaacaggacagccgtaatccttgaactcattagagttgatagtctaaagtaaatgcagaccattaatgggagattaaatatgttatggcacatacaaagtgcaagaaagaacataatgtcatgtgagggaatgcataaatagcttaatttagccatcccgtaacatattcatatattaaaacatcatgttacgtgctctaacttgatagaatttttacttgtcaaatcaaaaaaatacaaaattcaaagaacatgcaagaattacctccctgaacttagaaggtgccagaggtagccacttggaagagatgtccactacattaagaagataaatgtaaattagccaataaaaggaagtcagaattgagattatgccagtaaaagggaacaacatgtttaaggccaagaatcaagagggccacagtgtaggttgggaaataaaaaataaaatttctgtatagctagagcagggagtaaaagacaccagcaggacttatattatgaagggacttttaagccacattaaggataaagcttttggctgcgcgcaatgtctcacgcctataatcccagcacttagggaggccgaggtgggtggatcatcttaggtcaggagtttgagaccagcctgggcaaattggtgaaaccctgtctctactaaaaatacaaaaattcgccaggcatggtggcaggtacctgtaatcccagctacttgagaggctgaggcaggagaatcacttgaaccagggaggcagaggttgcagtgagcagagattgtgccactgcactccagtctgggtgacagagagagactccgcctccatctcaaaaaaaaaaaaaaaaaaaaaagaatagagcttttatttgaaggacagtaaagaatcactagagaattttagacaggaagccccaattcgttattgagagaacacattgcagctgctttacaggtgggatgtggcagagtaaaatgccagtgaagaaactgatagcatatttgaggtaagatatagtaatgattttaactagagtaaagacaatggagagagagagaaaagattggaatcaagaactatttagaaggtataataaataattagtgattgactgattagatgcaacatgatgaaggacatgatagaggaagtagaaatatctagaattacatctaataaagggaatcattatttgtttttcgctgaaaccggaaaaaatacagagaaggaggaaaagcaagttggggagttgagaagtaggtgagaagagtatatgcaaggagttcatgtgtgggagtgttagcttttggtggttgcagaatattcatgaggagatgtccaatagggtgagataacatgcaagtatggagatcaaggggagatctggacttgagagatgtagagttgagagttgtcagaatgtgaggaggaattgaagttaaggtatgggtagaatgagaagaaaggaaagcccaggataaaatcttaatggagtcaaaatttatggtacagggagaagtactgggaaagccttccctcttcctgcagcatcactaaacttcctgttcttttgccttagtctagatgcctttaactgtagttttacttgggcaaagctgtgttataggctggcttcactgaagaataatgacatcactaatatttttaaagcttaaaaagtatagtatttatgtaatatctaatattctatatataatataaaaaccaagatcatcttaaaacctcagtcatgctctgtgggaaagaaagttatattgtacctgataatcatgcctttacattgtatattaaggaaatgtattttaaatgacacataatgaattcccaataagttgcctgccctatttcttacttttacaactactctgttaaaagtgaacagatccttgaagggagactttccaatctgtgcagcatggtatttatacttgaacattattgaattatcctaatcatacttatagttacaatcaagattaattgcagctatattaggattacttattattttttctacttcagcagtaacataaacccaattgtacaaacaatttctgtaatccaaattgtgaaagaaagtagggagaaaaaagatcatgcaaagctggttgaaatagtattcaaaataaatctttaaccagactgttatctaaaattctgtttttgacaaggagctgattctgaacagattgtacatgtatctcactggtggaagcagattatctgtcttgaattggattgtgatgacgatgaccctattctaagcaaaccaaatctcttgaactatataatgagatcaggaggaacattcgacctgagaaagacagattgcaatgactgagatgattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgtta
